US011466292B2

(12) United States Patent
Burny et al.

(10) Patent No.: US 11,466,292 B2
(45) Date of Patent: Oct. 11, 2022

(54) COMPOSITIONS AND METHODS OF TREATMENT

(71) Applicant: GLAXOSMITHKLINE BIOLOGICALS S.A., Rixensart (BE)

(72) Inventors: Wivine Burny, Rixensart (BE); Cindy Castado, Rixensart (BE); Sandra Giannini, Rixensart (BE); Julien Thierry Massaux, Rixensart (BE)

(73) Assignee: GLAXOSMITHKLINE BIOLOGICALS SA, Rixensart (BE)

( * ) Notice: Subject to any disclaimer, the term of this patent is extended or adjusted under 35 U.S.C. 154(b) by 0 days.

(21) Appl. No.: 16/332,420

(22) PCT Filed: Sep. 27, 2017

(86) PCT No.: PCT/EP2017/074552
§ 371 (c)(1),
(2) Date: Mar. 12, 2019

(87) PCT Pub. No.: WO2018/060288
PCT Pub. Date: Apr. 5, 2018

(65) Prior Publication Data
US 2020/0123571 A1  Apr. 23, 2020

Related U.S. Application Data

(60) Provisional application No. 62/445,839, filed on Jan. 13, 2017, provisional application No. 62/401,565, filed on Sep. 29, 2016.

(51) Int. Cl.
*A61K 39/12* (2006.01)
*C12N 15/86* (2006.01)
(Continued)

(52) U.S. Cl.
CPC ............ *C12N 15/86* (2013.01); *A61K 35/761* (2013.01); *A61K 39/12* (2013.01); *A61P 31/20* (2018.01);
(Continued)

(58) Field of Classification Search
None
See application file for complete search history.

(56) References Cited

U.S. PATENT DOCUMENTS

2006/0247190 A1* 11/2006 Beach ................. A61P 15/00
514/44 R
2010/0143408 A1* 6/2010 Baudin ................ A61P 31/00
424/204.1
(Continued)

FOREIGN PATENT DOCUMENTS

EP    1195438 A1    4/2002
WO   03031583 A2    4/2003
(Continued)

OTHER PUBLICATIONS

Cullen et al., "Deep sequencing of HPV16 genomes: A new high-throughput tool for exploring the carcinogenicity and natural history of HPV16 infection," Papillomavirus Research 1: 3-11 (Year: 2015).*

(Continued)

*Primary Examiner* — M Franco G Salvoza

(57) ABSTRACT

The present invention relates to nucleic acid constructs capable of encoding antigenic peptides or polypeptides derived from multiple Human Papilloma Virus (HPV) early proteins, and to immunogenic compositions comprising such nucleic acid constructs and a pharmaceutically acceptable carrier. Such nucleic acid constructs and immunogenic compositions are useful in the treatment of persistent HPV infection and low-grade HPV lesions, particularly infections (Continued)

and lesions of human anogenital epithelial tissue, such as cervical epithelia.

20 Claims, 45 Drawing Sheets

Specification includes a Sequence Listing.

(51) Int. Cl.
*A61P 31/20* (2006.01)
*A61K 35/761* (2015.01)
*C07K 14/005* (2006.01)
*C12N 7/00* (2006.01)
*A61K 39/00* (2006.01)

(52) U.S. Cl.
CPC .............. *C07K 14/005* (2013.01); *C12N 7/00* (2013.01); *A61K 2039/5256* (2013.01); *C07K 2319/40* (2013.01); *C12N 2710/10343* (2013.01); *C12N 2710/20022* (2013.01); *C12N 2710/20034* (2013.01)

(56) References Cited

U.S. PATENT DOCUMENTS

| | | | |
|---|---|---|---|
| 2010/0158930 A1* | 6/2010 | Zhu | C12N 7/00 424/185.1 |
| 2020/0230226 A1 | 7/2020 | Burny et al. | |

FOREIGN PATENT DOCUMENTS

| | | |
|---|---|---|
| WO | 2004030636 A2 | 4/2004 |
| WO | 2005/089164 A2 | 9/2005 |
| WO | 2008/092854 A2 | 8/2008 |
| WO | 2008/138648 A1 | 11/2008 |
| WO | 2008/145745 A1 | 12/2008 |
| WO | 2011/106705 A2 | 9/2011 |
| WO | 2016198531 A2 | 12/2016 |
| WO | 2017029360 A1 | 2/2017 |
| WO | 2018060288 A1 | 4/2018 |

OTHER PUBLICATIONS

Anonymous, "High- and Low-Risk HPV Types—theHPVtest.com", (Nov. 16, 2017), URL: http://thehpvtest.com/about-hpv/nigh-and-low-risk-hpv-types/, (Nov. 16, 2017), XP055425654 [AP] 1-23 *section headed "Low risk types of HPV"*; p. 1.
Hung C-F. et al., "Therapeutic human papillomavirus vaccines: current clinical trials and future directions", Expert Opinion on Biological Therapy, vol. 8, No. 4, p. 421-439.
Kaufmann et al., Clinical Cancer Research, vol. 8: 3676-3685 (2002).
Khallouf et al., Vaccines, vol. 2: 422-462 (2014).
International Search Report and Written Opinion in corresponding International Application No. PCT/EP2018/076009 dated Dec. 19, 2018 (17 pages).
Trimble et al., Lancet, vol. 386:2078-2088 (2015).

* cited by examiner

FIGURE 1A

```
ChAd3     (1) MKRTKTSDESFNPVYPYDTESGPPSVPFLTPPFVSPDGFQESPPGVLSLNLAEPLVTSHGMLALKMGSGLSLDDAGNLTSQDITTASPPLKKTKTNLSLE
PanAd3    (1) MKRAKTSDETFNPVYPYDTENGPPSVPFLTPPFVSPDGFQESPPGVLSLRLSEPLVTSHGMLALKMGNGLSLDDAGNLTSQDVTTVTPLKKTKTNLSLQ
ChAd17    (1) MKRTKTSDESFNPVYPYDTESGPPSVPFLTPPFVSPDGFQESPPGVLSLNLAEPLVTSHGMLALKMGSGLSLDDAGNLTSQDITSTPPLKKTKTNLSLE
ChAd19    (1) MKRTKTSDKSFNPVYPYDTENGPPSVPFLTPPFVSPDGFQESPPGVLSLNLAEPLVTSHGMLALKMGSGLSLDDAGNLTSQDVTTTPPLKKTKTNLSLE
ChAd24    (1) MKRTKTSDESFNPVYPYDTENGPPSVPFLTPPFVSPDGFQESPPGVLSLNLAEPLVTSHGMLALKMGSGLSLDDAGNLTSQDVTTTTPLKKTKTNLSLE
ChAd155   (1) MKRTKTSDESFNPVYPYDTESGPPSVPFLTPPFVSPDGFQESPPGVLSLNLAEPLVTSHGMLALKMGSGLSLDDAGNLTSQDITTASPPLKKTKTNLSLE
ChAd11    (1) MKRTKTSDESFNPVYPYDTENGPPSVPFLTPPFVSPDGFQESPPGVLSLNLAEPLVTSHGMLALKMGSGLSLDDAGNLTSQDVTTTPPLKKTKTNLSLE
ChAd20    (1) MKRTKTSDESFNPVYPYDTESGPPSVPFLTPPFVSPDGFQESPPGVLSLNLAEPLVTSHGMLALKMGSGLSLDDAGNLTSQDITTASPPLKKTKTNLSLE
ChAd31    (1) MKRTKTSDESFNPVYPYDTESGPPSVPFLTPPFVSPDGFQESPPGVLSLNLAEPLVTSHGMLALKMGSGLSLDDAGNLTSQDITTASPPLKKTKTNLSLE
PanAd1    (1) MKRAKTSDETFNPVYPYDTENGPPSVPFLTPPFVSPDGFQESPPGVLSLRLSEPLVTSHGMLALKMGNGLSLDDAGNLTSQDVTTVTPLKKTKTNLSLQ
PanAd2    (1) MKRAKTSDETFNPVYPYDTENGPPSVPFLTPPFVSPDGFQESPPGVLSLRLSEPLVTSHGMLALKMGNGLSLDDAGNLTSQDVTTVTPLKKTKTNLSLQ

ChAd3   (101) TSSPLTVSTSGALTVAAAAPLAVAGTSLTMQSEAPLTVQDAKLTLATKGPLITVSEGKLALQTSAPLTAADSSTLTVSATPPINVSSGSLGLDMEDPMYTH
PanAd3  (101) TSAPLTVS-SGSLTVAAAAPLAVAGTSLTMQSQAPLTVQDAKLGLATQGPLITVSEGKLTLQTSAPLTAADSSTLTVGTTPPISVSSGSLGLDMEDPMYTH
ChAd17  (101) TSSPLTVSTSGALTVAAAAPLAVAGTSLTMQSEAPLTVQDAKLTLATKGPLITVSEGKLALQTSAPLTAADSSTLTVSSTPPISVSSGSLGLDMEDPMYTH
ChAd19  (101) TSAPLTVSTSGALTLAAAAPLAVAGTSLTMQSEAPLTVQDAKLTLATKGPLITVSEGKLALQTSAPLTAADSSTLTVSATPPISVSSGSLGLDMEDPMYTH
ChAd24  (101) TSAPLTVSTSGALTLAAAAPLAVAGTSLTMQSEAPLTVQDAKLTLATKGPLITVSEGKLALQTSAPLTAADSSTLTVSATPPINVSSGSLGLDMENPMYTH
ChAd155 (101) TSSPLTVSTSGALTVAAAVPLAVAGTSLTMQSEAPLTVQDAKLTLATKGPLITVSEGKLALQTSAPLTAADSSTLTVSATPPLSTSNGSLGIDMQAPIYTT
ChAd11  (101) TSSPLTVSTSGALTLAAAVPLAVAGTSLTMQSEAPLTVQDAKLTLATKGPLITVSEGKLALQTSAPLTAADSSTLTISATPPLSTSNGSLGIDMQAPIYTT
ChAd20  (101) TSSPLTVSTSGALTVAAAAPLAVAGTSLTMQSEAPLTVQDAKLTLATKGPLITVSEGKLALQTSAPLTAADSSTLTVSATPPLSTSNGSLGIDMQAPIYTT
ChAd31  (101) TSSPLTVSTSGALTVAAAAPLAVAGTSLTMQSEAPLTVQDAKLTLATKGPLITVSEGKLALQTSAPLTAADSSTLTVSATPPLSTSNGSLGIDMQAPIYTT
PanAd1  (101) TSAPLTVS-SGSLTVAAAAPLAVAGTSLTMQSQAPLTVQDAKLGLATQGPLITVSEGKLTLQTSAPLTAADSSTLTVSATPPLSTSNGSLSIDMQAPIYTT
PanAd2  (101) TSAPLTVS-SGSLTVAAAAPLAVAGTSLTMQSQAPLTVQDAKLGLATQGPLITVSEGKLTLQTSAPLTAADSSTLTVSATPPLSTSNGSLSIDMQAPIYTT
```

FIGURE 1B

```
ChAd3   (201) DGKLGIRIGGPLRVVDSLHTLTVVTGNGLTVDNNALQTRVTGALGYDTSGNLQLRAAGGMRIDANGQLINVAYPFDAQNNLSLRLGQGPLYINTDHNLD
PanAd3  (200) DGKLGIRIGGPLQVVDSLHTLTVVTGNGLTVDNNALQTRVTGALGYDSSGNLELRAAGGMRINTGGQLILDVAYPFDAQNNLSLRLGQGPLYVNTNHNLD
ChAd17  (201) DGKLGIRIGGPLRVVDSLHTLTVVTGNGLTVANNALQTKVAGALGYDSSGNLELRAAGGMRIDANGQLILDVAYPFDAQNNLSLRLGQGPLYVNTDHNLD
ChAd19  (201) DGKLGIRIGGPLRVVDSLHTLTVVTGNGLIAVDNNALQTRVTGALGYDTSGNLQLRAAGGMRIDANGQLILDVAYPFDAQNNLSLRLGQGPLYVNTDHNLD
ChAd24  (201) DGKLGIRIGGPLRVVDSLHTLTVVTGNGIAVDNNALQTRVTGALGYDTSGNLQLRAAGGMRIDANGQLILDVAYPFDAQNNLSLRLGQGPLYVNTDHNLD
ChAd155 (201) NGKLGLNFGAPLHVVDSLNALTVVTGQLTINGTALQTRVSGALNYDTSGNLELRAAGGMRVDANGQLILDVAYPFDAQNNLSLRLGQGPLFVNSAHNLD
ChAd11  (201) NGKLGLNFGAPLHVVDSLNALTVVTGQLTINGTALQTRVSGALNYDSSGNLELRAAGGMRVDANGKLILDVAYPFDAQNNLSLRLGQGPLFVNSAHNLD
ChAd20  (201) NGKLGLNFGAPLHVVDSLNALTVVTGQLTINGTALQTRVSGALNYDTSGNLELRAAGGMRVDANGQLILDVAYPFDAQNNLSLRLGQGPLFVNSAHNLD
ChAd31  (201) NGKLGLNFGAPLHVVDSLNALTVVTGQLTINGTALQTRVSGALNYDTSGNLELRAAGGMRVDANGQLILDVAYPFDAQNNLSLRLGQGPLFVNSAHNLD
PanAd 1 (200) NGKLALNIGAPLHVVDTLNALTVVTGQLTINGRALQTRVTGALSYDTEGNIQLQAGGMRIDNNGQLILNVAYPFDAQNNLSLRLGQGPLIVNSAHNLD
PanAd2  (200) NGKLALNIGAPLHVVDTLNALTVVTGQLTINGRALQTRVTGALSYDTEGNIQLQAGGMRIDNNGQLILNVAYPFDAQNNLSLRLGQGPLIVNSAHNLD

ChAd3   (301) LNCNRGLTTTTNNTKKLET------------------------------KISSGLDYDTNGAVIIKLGTGLSFDNTGALTVGNTGDDKLTLWT
PanAd3  (300) LNCNRGLTTTTSSNTTKLET-----------------------------KIDSGLDYNANGAIIAKLGTGLTFDNTGAITVGNTGDDKLTLWT
ChAd17  (301) LNCNRGLTTTTTNNTKKLET------------------------------KISSGLDYDTNGAVIIKLGTGLSFDNTGALTVGNTGDDKLTLWT
ChAd19  (301) LNCNRGLTTTTTNNTKKLET------------------------------KIGSGLDYDTNGAVIIKLGTGVSFDSTGALSVGNTGDDKLTLWT
ChAd24  (301) LNCNRGLTTTTTNNTKKLET------------------------------KIGSGLDYDTNGAVIIKLGTGVSFDSTGALSVGNTGDDKLTLWT
ChAd155 (301) VNYNRGLYLFTSGNTKKLEVNIKTAKGLIYDDTAIAINAGDLQFDSGSDTNPLKTKLGLGLEYDSSRAIIAKLGTGLSFDNTGAITVGNKNDDKLTLWT
ChAd11  (301) VNYNRGLYLFTSGNTKKLEVNIKTAKGLIYDDTAIAINPGDGLEFGSGSDTNPLKTKLGLGLEYDSSRAIIAKLGTGLSFDNTGAITVGNKNDDKLTLWT
ChAd20  (301) VNYNRGLYLFTSGNTKKLEVNIKTAKGLIYDDTAIAINAGDLQFDSGSDTNPLKTKLGLGLEYDSSRAIIAKLGTGLSFDNTGAITVGNKNDDKLTLWT
ChAd31  (301) VNYNRGLYLFTSGNTKKLEVNIKTAKGLFYDGTAIAINAGDLQFDSGSDTNPLKTKLGLGLEYDSNKAIITKLGTGLSFDNTGAITVGNKNDDKLTLWT
PanAd1  (300) LNLNRGLYLFTSGNTKKLEVNIKTAKGLFYDGTAIAINAGDLQFGSGSDTNPLQTKLGLGLEYDSNKAIITKLGTGLSFDNTGAITVGNKNDDKLTLWT
PanAd2  (300) LNLNRGLYLFTSGNTKKLEVNIKTAKGLFYDGTAIAINAGDLQFGSGSDTNPLQTKLGLGLEYDSNKAIITKLGTGLSFDNTGAITVGNKNDDKLTLWT
```

FIGURE 1C

```
ChAd3    (365) TPDPSPNCRIHSDKDCKFTLVLTKCGSQILASVAALAVSGNLASITGTVASVTIFLRFDQNGVLMENSSLDRQYWNFRNGNSTNAAPYTNAVGFMPNLAA
PanAd3   (364) TPDPSPNCRIHADKDCKFTLVLTKCGSQILASVAALAVSGNLSSMTGTVSSVTIFLRFDQNGVLMENSSLDKEYWNFRNGNSTNATPYTNAVGFMPNLSA
ChAd17   (365) TPDPSPNCRIHSDKDCKFTLVLTKCGSQILASVAALAVSGNLASITGTVASVTIFLRFDQNGVLMENSSLDKQYWNFRNGNSTNAAPYTNAVGFMPNLAA
ChAd19   (365) TPDPSPNCRIHSDKDCKFTLVLTKCGSQILASVAALAVSGNLASITGTVSSVTIFLRFDQNGVLMENSSLDKQYWNFRNGNSTNATPYTNAVGFMPNLAA
ChAd24   (365) TPDPSPNCRIHSDKDCKFTLVLTKCGSQILASVAALAVSGNLASITGTVASVTIFLRFDQNGVLMENSSLDKQYWNFRNGNSTNATPYTNAVGFMPNLAA
ChAd155  (401) TPDPSPNCRIYSEKDAKFTLVLTKCGSQVLASVSVLSVKGSLAPISGTVTSAQIVLRFDENGVLLSNSSLDPQYWNYRKGDLTEGTAYTNAVGFMPNLTA
ChAd11   (401) TPDPSPNCRIYSEKDAKFTLVLTKCGSQVLASVSVLSVKGSLAPISGTVTSAQIILRFDENGVLLSNSSLDPQYWNYRKGDLTEGTAYTNAVGFMPNLTA
ChAd20   (401) TPDPSPNCRIYSEKDAKFTLVLTKCGSQVLASVSVLSVKGSLAPISGTVTSAQIVLRFDENGVLLSNSSLDPQYWNYRKGDLTEGTAYTNAVGFMPNLTA
ChAd31   (401) TPDPSPNCRIYSEKDAKFTLVLTKCGSQVLASVSVLSVKGSLAPISGTVTSAQIVLRFDENGVLLSNSSLDPQYWNYRKGDSTEGTAYTNAVGFMPNLTA
PanAd1   (400) TPDPSPNCRINSEKDAKLTLVLTKCGSQVLASVSVLSVKGSLAPISGTVTSAQIVLRFDENGVLLSNSSLDPQYWNYRKGDSTEGTAYTNAVGFMPNLTA
PanAd2   (400) TPDPSPNCRINSEKDAKLTLVLTKCGSQVLASVSVLSVKGSLAPISGTVTSAQIVLRFDENGVLLSNSSLDPQYWNYRKGDSTEGTAYTNAVGFMPNLTA

ChAd3    (465) YPKTQSQTAKNNIVSQVYLNGDKSKPMTLTITLNGTNESSETSQVSHYSMSFTWAWESGQYATETFATNSFTFSYIAEQ   (SEQ ID NO:27)
PanAd3   (464) YPKTQSQTAKNNIVSEVYLHGDKSKPMILTITLNGTNESSETSQVSHYSMSFTWSDSGKYATETFATNSFTFSYIAEQ   (SEQ ID NO:28)
ChAd17   (465) YPKTQSQTAKNNIVSQVYLNGDKSKPMTLTITLNGTNESSETSQVSHYSMSFTWAWESGQYATETFATNSFTFSYIAEQ  (SEQ ID NO:29)
ChAd19   (465) YPKTQSQTAKNNIVSQVYLNGDKSKPMTLTITLNGTNESSETSQVSHYSMSFTWAWESGQYATETFATNSFTFSYIAEQ  (SEQ ID NO:30)
ChAd24   (465) YPKTQSQTAKNNIVSQVYLNGDKSKPMTLTITLNGTNESSETSQVSHYSMSFTWAWESGQYATETFATNSFTFSYIAEQ  (SEQ ID NO:31)
ChAd155  (501) YPKTQSQTAKSNIVSQVYLNGDKSKPMLTITLNGTNETG-DATVSTYSMSFSWNWNGSNYINETFQTNSFTFSYIAQE  (SEQ ID NO:1)
ChAd11   (501) YPKTQSQTAKSNIVSQVYLNGDKSKPMLTITLNGTNETG-DATVSTYSMSFSWNWNGSNYINETFQTNSFTFSYIAQE   (SEQ ID NO:32)
ChAd20   (501) YPKTQSQTAKSNIVSQVYLNGDKSKPMLTITLNGTNETG-DATVSTYSMSFSWNWNGSNYINETFQTNSFTFSYIAQE   (SEQ ID NO:33)
ChAd31   (501) YPKTQSQTAKSNIVSQVYLNGDKTKPMLTITLNGTNETG-DATVSTYSMSFSWNWNGSNYINETFQTNSFTFSYIAQE   (SEQ ID NO:34)
PanAd1   (500) YPKTQSQTAKSNIVSQVYLNGDKTKPMLTITLNGTNETG-DATVSTYSMSFSWNWNGSNYINDTFQTNSFTFSYIAQE   (SEQ ID NO:35)
PanAd2   (500) YPKTQSQTAKSNIVSQVYLNGDKTKPMLTITLNGTNETG-DATVSTYSMSFSWNWNGSNYINDTFQTNSFTFSYIAQE   (SEQ ID NO:36)
```

● HPV16E2 – Type Specific
○ HPV18E2 – Type Specific
▫ HPV35E2 – Cross Reactive
▫ HPV35E2 T Cell Fragments – Cross Reactive ○ HPV16E7 | Type-specific
● HPV18E7
◐ HPV35E7 | Cross-reactive FIGURE 36
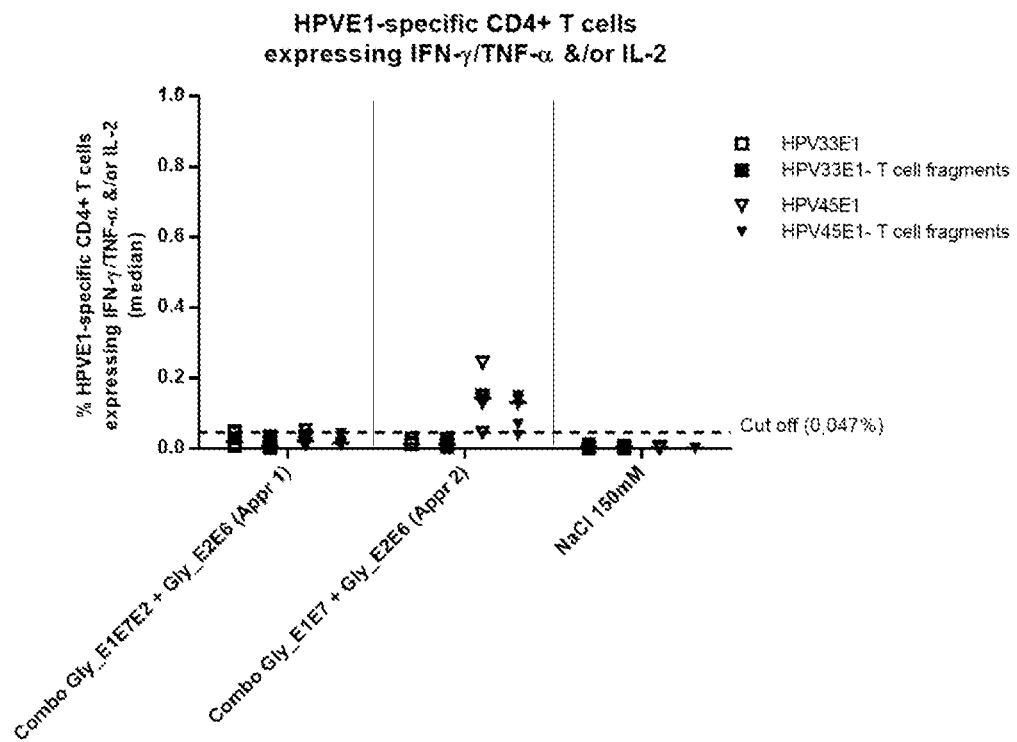
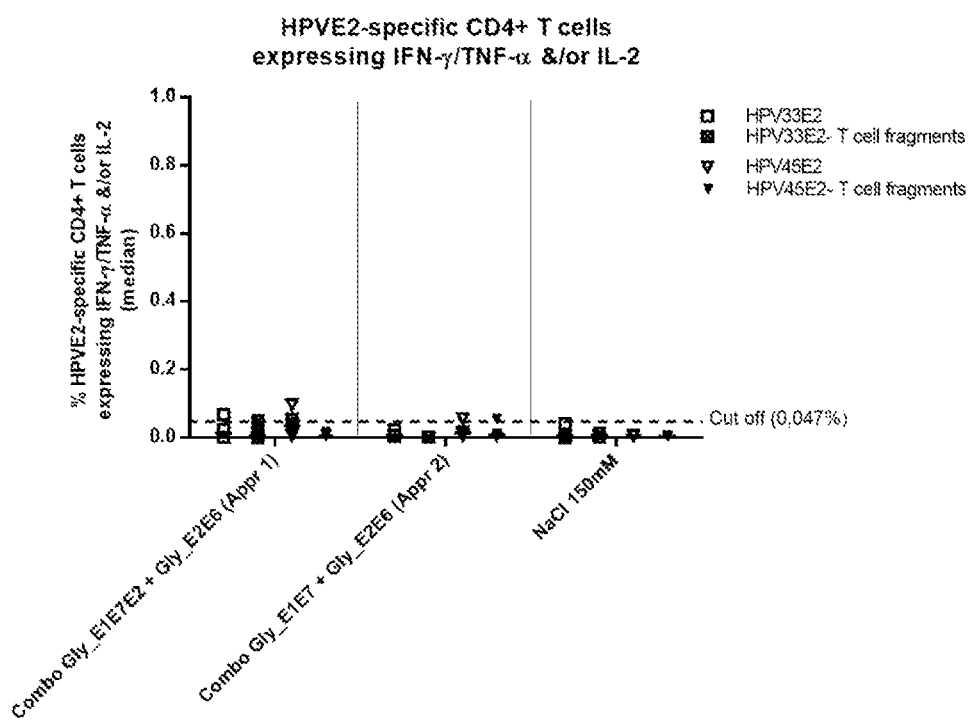

FIGURE 37

A) Gly_E2$^7$E7$^2$

| HPV16 | HPV18 | HPV31 | HPV33 | HPV45 | HPV52 | HPV58 | HPV 16 | HPV 18 |
|---|---|---|---|---|---|---|---|---|
| *Fragments of E2* | | | | | | | *Fragments of E7* | |

B) Gly_E1E6$^7$E1

| HPV16 | HPV16 | HPV18 | HPV31 | HPV33 | HPV45 | HPV52 | HPV58 | HPV 18 |
|---|---|---|---|---|---|---|---|---|
| *Frag E1* | *Fragments of E6* | | | | | | | *Frag of E1* |

C) Gly_E1$^2$E6$^7$

| HPV16 | HPV18 | HPV16 | HPV18 | HPV31 | HPV33 | HPV45 | HPV52 | HPV58 |
|---|---|---|---|---|---|---|---|---|
| *Fragments E1* | | *Fragments of E6* | | | | | | |

FIGURE 38
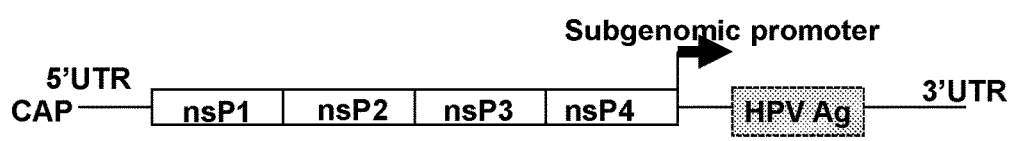
FIGURE 39
Fig. 2A - Gly_E2$^4$
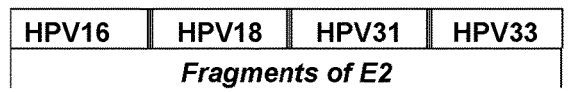
Fig. 2B - Gly_E2$^3$E7$^2$
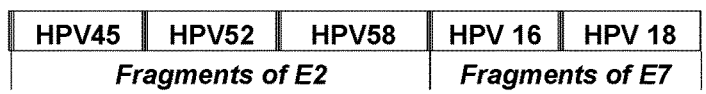
Fig. 2C - Gly_E1$^2$E6$^7$
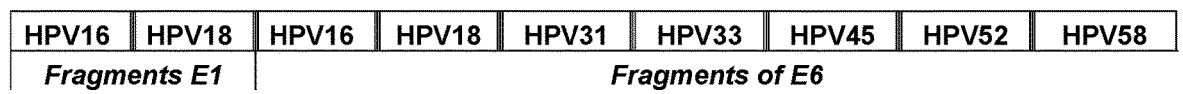

COMPOSITIONS AND METHODS OF TREATMENT

CROSS-REFERENCE TO RELATED APPLICATIONS

This application is filed pursuant to 35 U.S.C. § 371 as a United States National Phase Application of International Application No. PCT/EP2017/074552 filed 27 Sep. 2017 which claims priority from U.S. provisional Nos. 62/401,565 and 62/445,839, filed 29 Sep. 2016 and 13 Jan. 2017, respectively.

FIELD OF THE INVENTION

The present invention relates to immunogenic constructs and compositions useful in the treatment of persistent HPV infection and low-grade HPV lesions, particularly infections and lesions of human anogenital epithelial tissue, such as cervical epithelia.

BACKGROUND

Human Papillomavirus (HPV) is a small DNA virus that infects mucosal and/or cutaneous skin and causes multiple disease conditions, including common warts, anogenital warts (condyloma acuminate), and neoplastic conditions of the epithelium (cervical neoplasia, cervical cancer, and other anogenital cancers). There are over 40 types of HPV known to infect the anogenital tract of humans and about 15 high-risk HPV genotypes are causally associated with human cervical cancers.

A majority of HPV infections of the cervical epithelium are subclinal and self-resolving within a two years period. However, persistant infection with high risk HPV types may cause lesions and progress to invasive cancer. Large-scale epidemiological studies have identified infection with high-risk HPV types as the major risk factor for cervical cancer, which is reported to be one of the most common cancers in women worldwide. The risk that an HPV infection will progress to clinical disease varies with the type of HPV. HPV types have been divided into those known to be associated with high-grade cervical intraepithelial neoplasia and cancer, and those not known to be associated with high-grade lesions or cancer.

Due to a lack of approved treatments for persistent cervical HPV infection, LSIL (low grade squamous intraepithelial lesions) and CIN1 (cervical intraepithelial neoplasia grade 1), health care providers may choose to 'wait and watch' these conditions, causing stress and anxiety in the patient. In view of the risk of progression to cervical cancer, there is a need for therapeutic treatments for HPV infection.

SUMMARY OF THE INVENTION

One aspect of the present invention is nucleic acid constructs capable of encoding antigenic peptides or polypeptides derived from multiple Human Papilloma Virus (HPV) early proteins, said nucleotide constructs useful as components of immunogenic compositions for the induction of cross-reactive cell-mediated immunity against more than one high-risk HPV type.

Another aspect of the invention is a nucleic acid therapeutic vaccine comprising a pharmaceutically acceptable carrier and one or more vector(s) comprising a nucleic acid construct encoding antigenic peptides or polypeptides derived from multiple HPV early proteins. In one embodiment, the one or more vector(s) are non-human adenoviral vector(s). In some embodiments, an immunogenic composition is provided comprising one or more adenoviral vector(s) comprising nucleotide constructs capable of encoding multiple antigenic peptides or polypeptides derived from Human Papilloma Virus early proteins. One embodiment provides a method of treating persistent HPV cervical infection and/or low-grade HPV lesions (CIN1, LSIL) comprising administering an effective amount of an immunogenic composition comprising a pharmaceutically acceptable carrier and one or more vector(s) comprising a nucleic acid construct encoding multiple antigenic peptides or polypeptides derived from HPV early proteins, where such administration results in production of cross-reactive cell-mediated immunity against more than one high-risk HPV type. In another aspect, the present invention provides one or more recombinant vector(s) comprising nucleic acid sequences encoding antigenic Human Papillomavirus (HPV) polypeptides from a first HPV early protein, where the antigenic HPV polypeptides are from at least two different high-risk HPV types and share at least 70% amino acid sequence identity with at least one additional high-risk HPV type, and encoding antigenic HPV polypeptides from a second HPV early protein, where these antigenic HPV polypeptides are from at least two different high-risk HPV types, and share at least 70% amino acid sequence identity with at least one additional high-risk HPV type; each of the antigenic HPV polypeptides includes at least one T cell epitope, and the nucleic acid sequences are operatively linked to one or more sequences which direct expression of the antigenic HPV polypeptides in a mammalian host cell. In one embodiment, the recombinant vector(s) of the present invention do not comprise any nucleic acid sequence encoding an antigenic polypeptide from an HPV Late 1 (L1) or Late 2 (L2) protein. In one embodiment, the recombinant vector(s) of the invention are adenovirus vector(s) capable of infecting mammalian, such as human epithelial cells. Such recombinant vectors may be non-human primate adenovirus vector, such as a simian adenovirus vector or a chimpanzee adenovirus (ChAd) vector, such as a ChAd 155 adenovirus vector. The recombinant vector(s) may comprise a modified backbone construct of ChAd155 selected from ChAd155 #1434 (SEQ ID NO: 7), ChAd155 #1390 (SEQ ID NO: 8) and ChAd155 #1375 (SEQ ID NO: 9). A further aspect is immunogenic compositions comprising a recombinant vector of the invention, and comprising a pharmaceutically acceptable carrier. A further aspect is a recombinant vector or immunogenic composition of the invention for use as a medicament. A further aspect is recombinant vector or immunogenic composition of the invention for use in the treatment of an HPV-related condition of the human anogenital tract, selected from infection by HPV such as a high-risk HPV type, and, lesions of the cervical epithelium, such as Cervical Intraepithelial Neoplasia grade 1 (CIN1) and low-grade squamous intraepithelial lesions (LSIL).

A further aspect of the present invention is a method of inducing an immune response in a mammalian subject by administering to the subject a recombinant vector or immunogenic composition of the invention.

A further aspect of the present invention is a method of treating HPV-related disease in a mammalian subject in need of such treatment by administering to the subject a recombinant vector or immunogenic composition of the invention.

BRIEF DESCRIPTION OF THE DRAWINGS

FIGS. 1A, 1B, 1C: alignment of the fiber protein sequences from Group C simian adenoviruses: ChAd3 (SEQ ID NO:27); PanAd3 (SEQ ID NO:28); ChAd17 (SEQ ID NO:29); ChAd19 (SEQ ID NO:30); ChAd24 (SEQ ID NO:31); ChAd155 (SEQ ID NO:1); ChAd11 (SEQ ID NO:32); ChAd20 (SEQ ID NO:33); ChAd31 (SEQ ID NO:34); PanAd1 (SEQ ID NO:35); PanAd2 (SEQ ID NO:36).

The data are shown for individual mice with the median per group indicated by a horizontal line; legend applies to both (A) and (B).

FIG. 25 graphs the percentage of HPV-E1-specific and cross reactive T cell responses detected in spleen cells of CD-1 mice collected after immunization with ChAd155 vector constructs Gly_E2$^3$E6$^5$E1$^2$E7$^2$ (first column), Gly_E1$^2$E7$^2$ and Gly-E2$^3$E6$^5$ (second column), 2A_E1$^2$E7$^2$ and 2A_E2$^3$E6$^5$ (third column), and NaCl 150 mM (fourth column): (A) results for E1-specific and cross reactive CD4+ T cell reponses; (B) results for E1-specific CD8+ T cell reponses. The data are shown for individual mice with the median per group indicated by a horizontal line; legend applies to both (A) and (B).

Figure 26A:
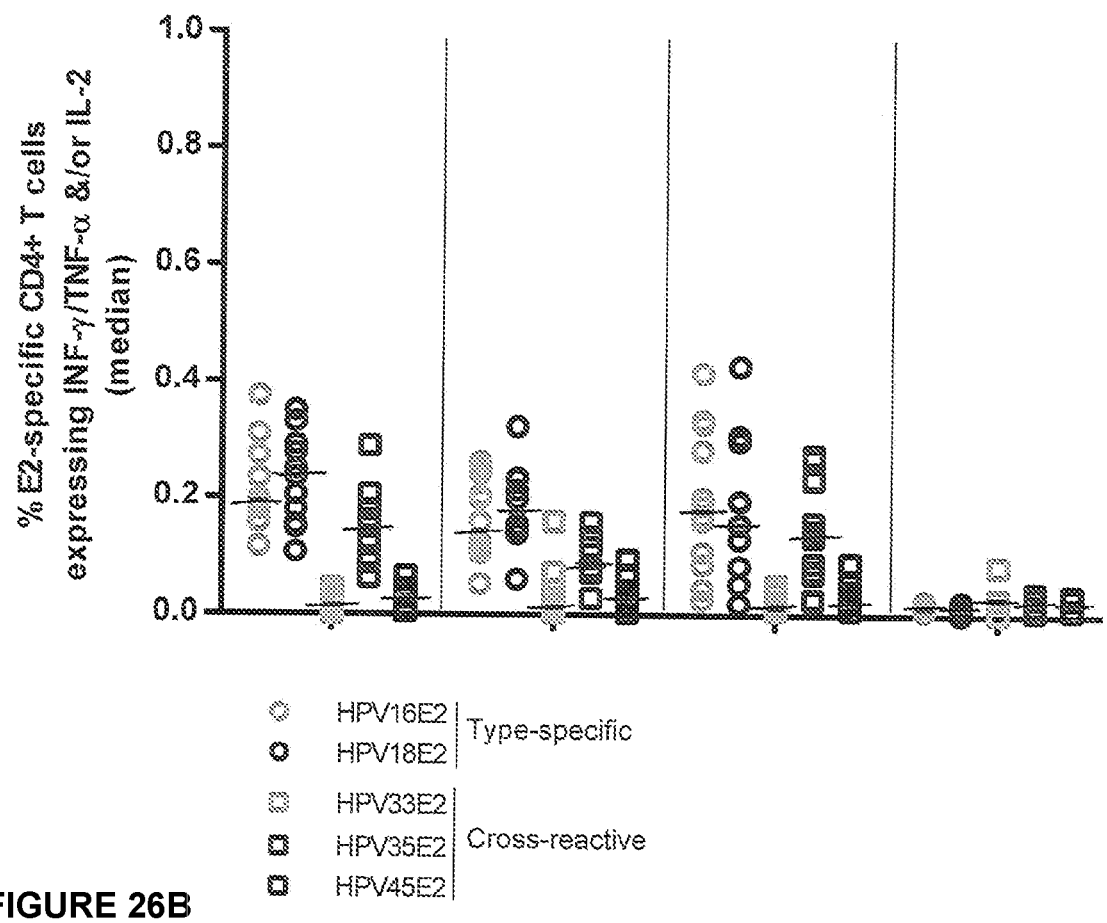
Figure 26B:
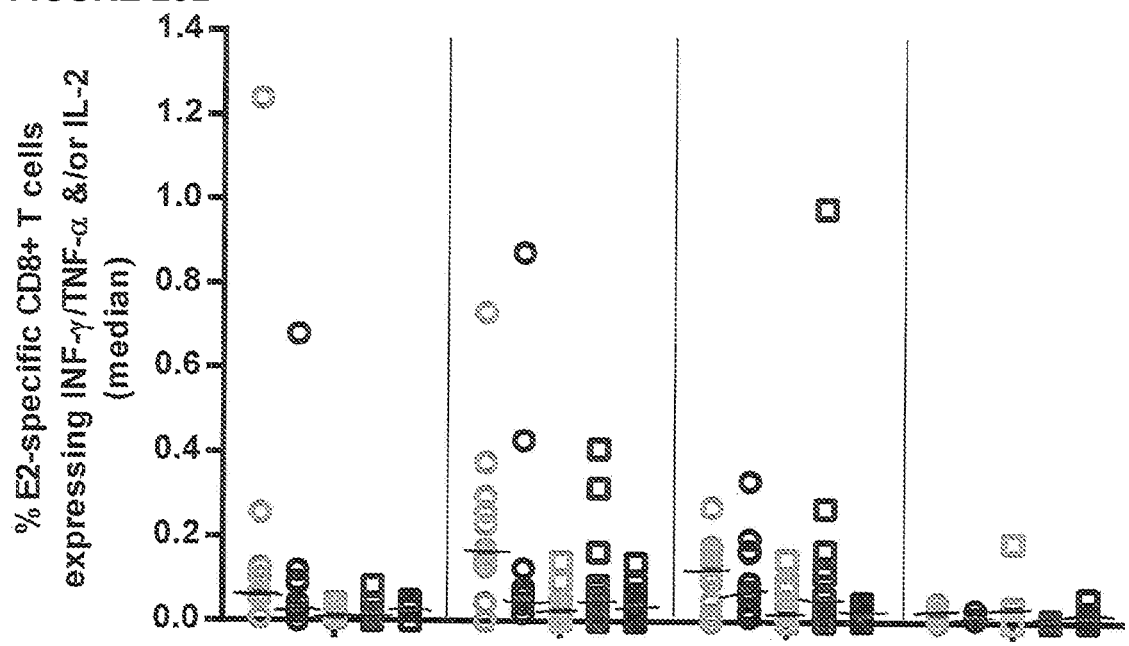

FIG. 26 graphs the percentage of HPV-E2-specific and cross reactive T cell responses detected in spleen cells of CD-1 mice collected after immunization with ChAd155 vector constructs Gly_E2$^3$E6$^5$E1$^2$E7$^2$ (first column), Gly_E1$^2$E7$^2$ and Gly-E2$^3$E6$^5$ (second column), 2A_E1$^2$E7$^2$ and 2A_E2$^3$E6$^5$ (third column), and NaCl 150 mM (fourth column): (A) results for E2-specific and cross reactive CD4+ T cell reponses; (B) results for E2-specific and cross reactive CD8+ T cell reponses. The data are shown for individual mice with the median per group indicated by a horizontal line; legend applies to both (A) and (B).

Figure 27A:
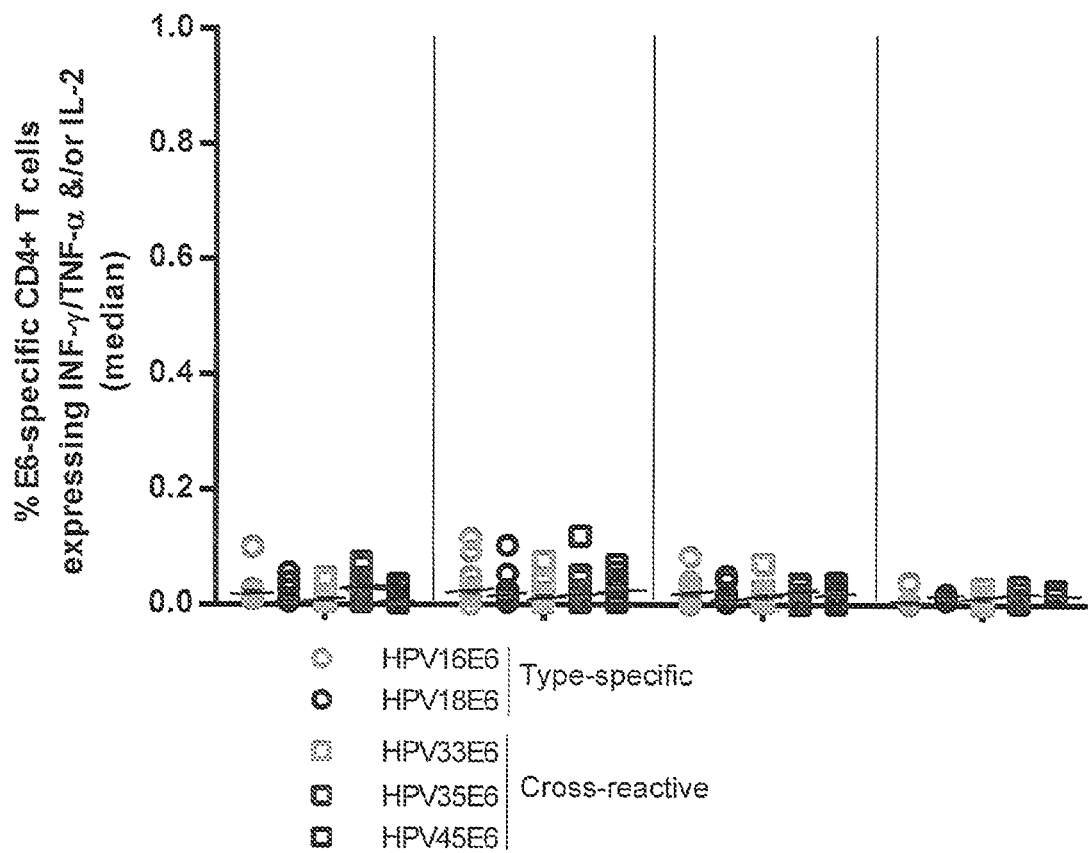
Figure 27B:
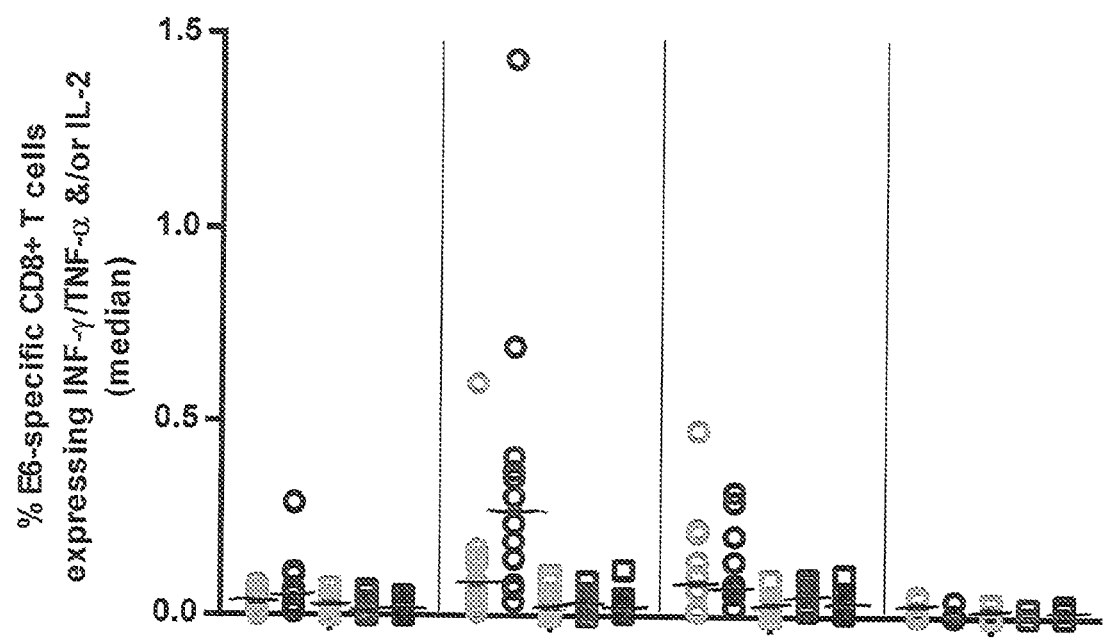

FIG. 27 graphs the percentage of HPV-E6-specific and cross reactive T cell responses detected in spleen cells of CD-1 mice collected after immunization with ChAd155 vector constructs Gly_E2$^3$E6$^5$E1$^2$E7$^2$ (first column), Gly_E1$^2$E7$^2$ and Gly-E2$^3$E6$^5$ (second column), 2A_E1$^2$E7$^2$ and 2A_E2$^3$E6$^5$ (third column), and NaCl 150 mM (fourth column): (A) results for E6-specific and cross reactive CD4+ T cell responses; (B) results for E6-specific and cross reactive CD8+ T cell responses. The data are shown for individual mice with the median per group indicated by a horizontal line; legend applies to both (A) and (B).

Figure 28A:
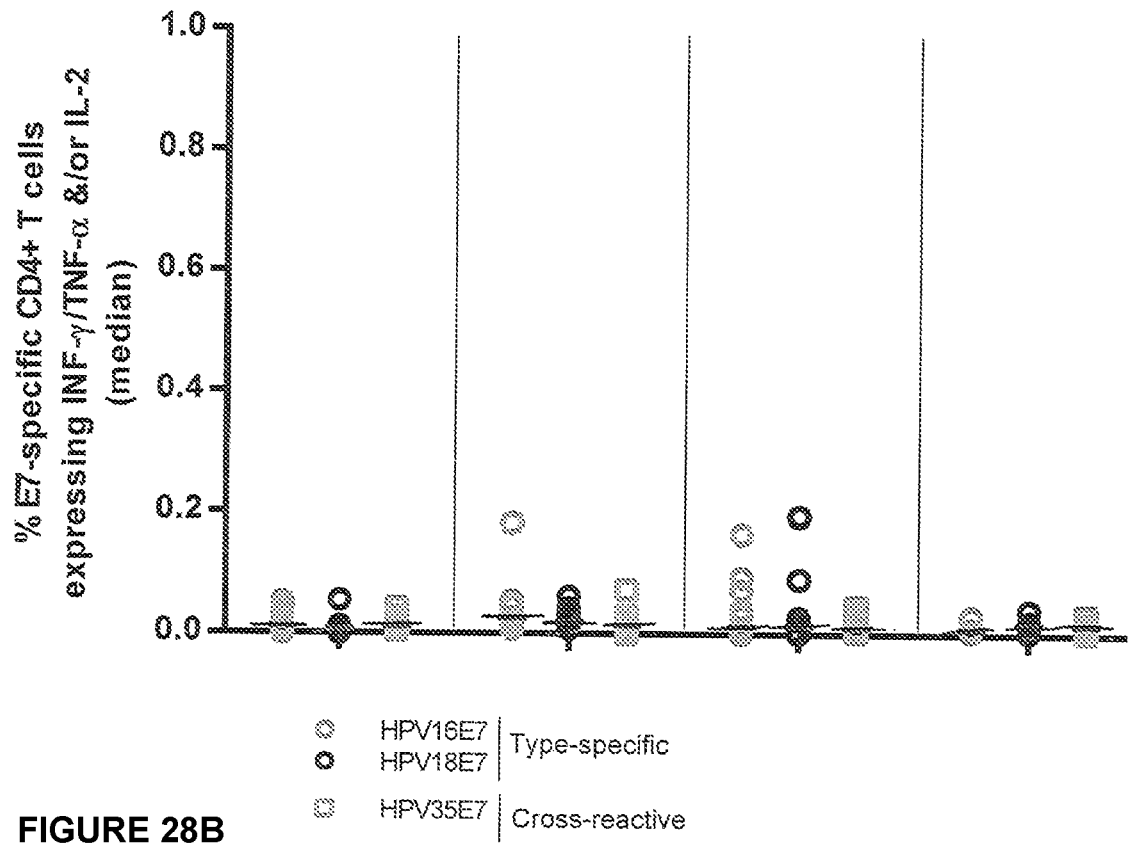
Figure 28B:
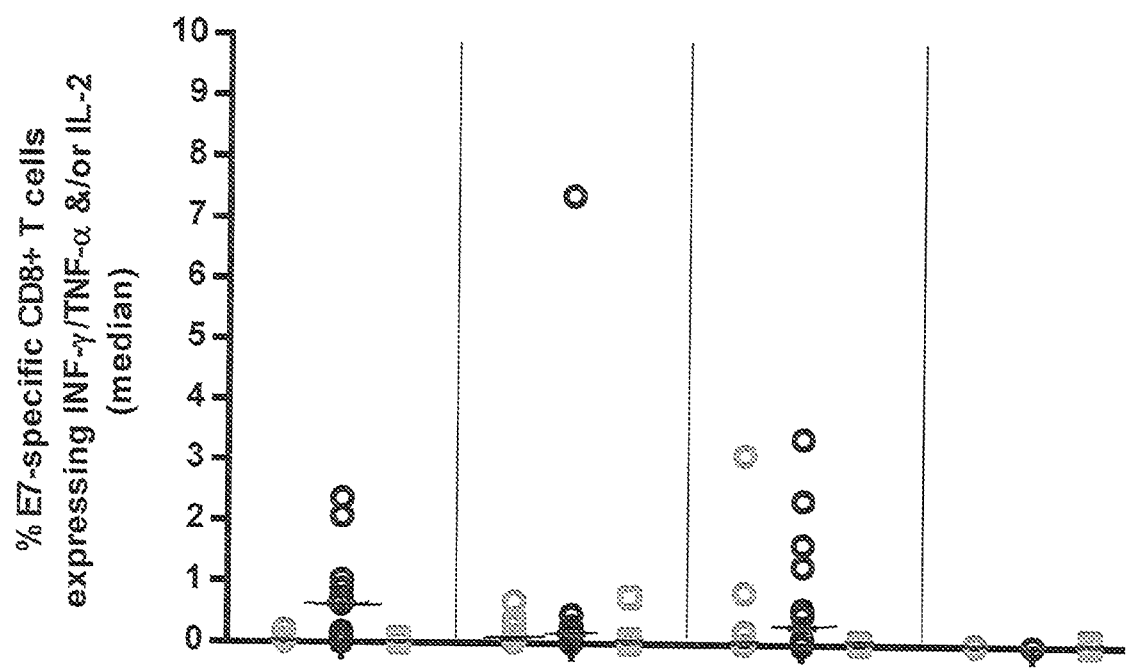

FIG. 28 graphs the percentage of HPV-E7-specific and cross reactive T cell responses detected in spleen cells of CD-1 mice collected after immunization with ChAd155 vector constructs Gly_E2$^3$E6$^5$E1$^2$E7$^2$ (first column), Gly_E1$^2$E7$^2$ and Gly-E2$^3$E6$^5$ (second column), 2A_E1$^2$E7$^2$ and 2A_E2$^3$E6$^5$ (third column), and NaCl 150 mM (fourth column): (A) results for E7-specific and cross reactive CD4+ T cell responses; (B) results for E7-specific and cross reactive CD8+ T cell responses. The data are shown for individual mice with the median per group indicated by a horizontal line; legend applies to both (A) and (B).

Figure 29:
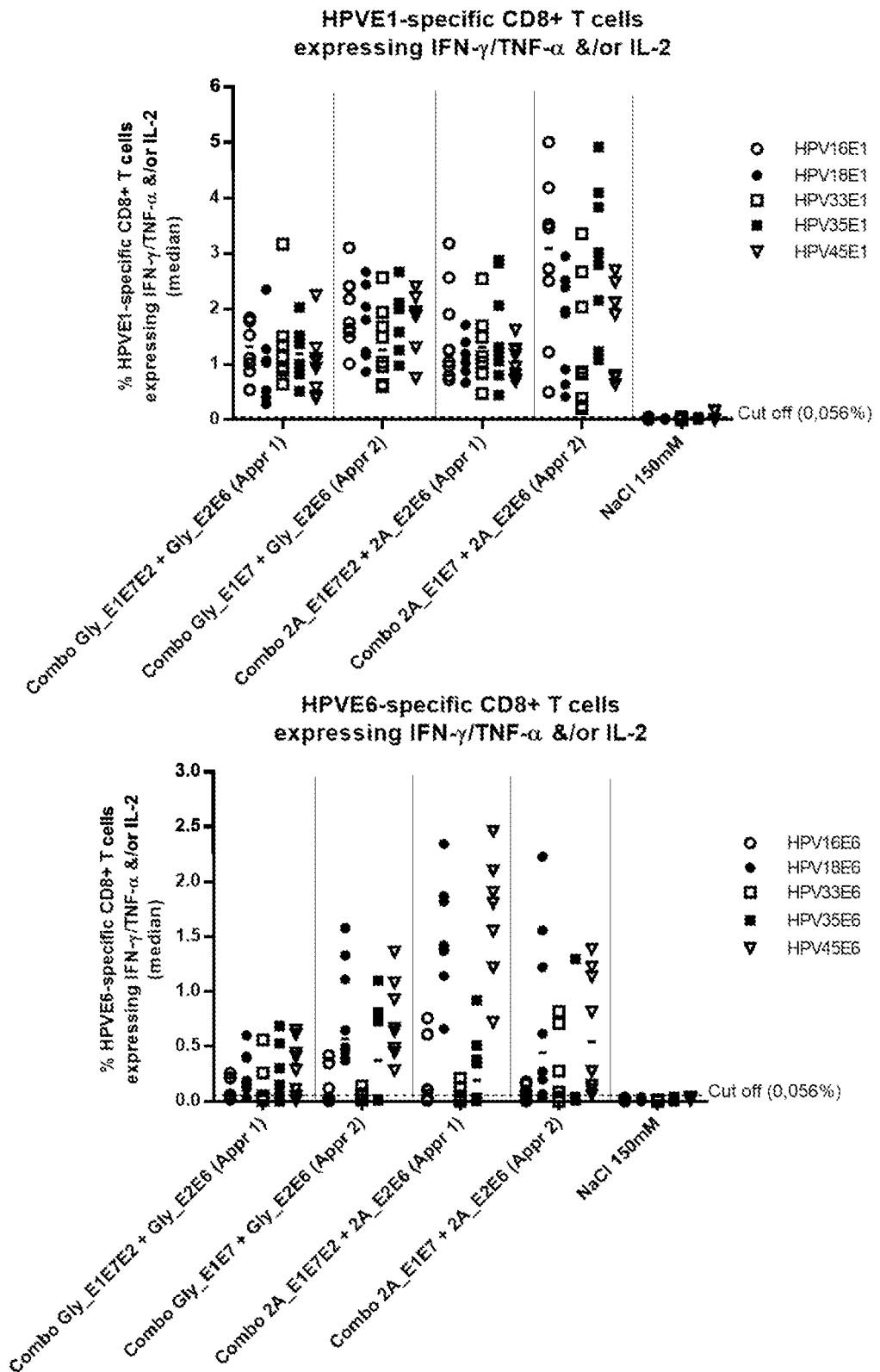
Figure 29:
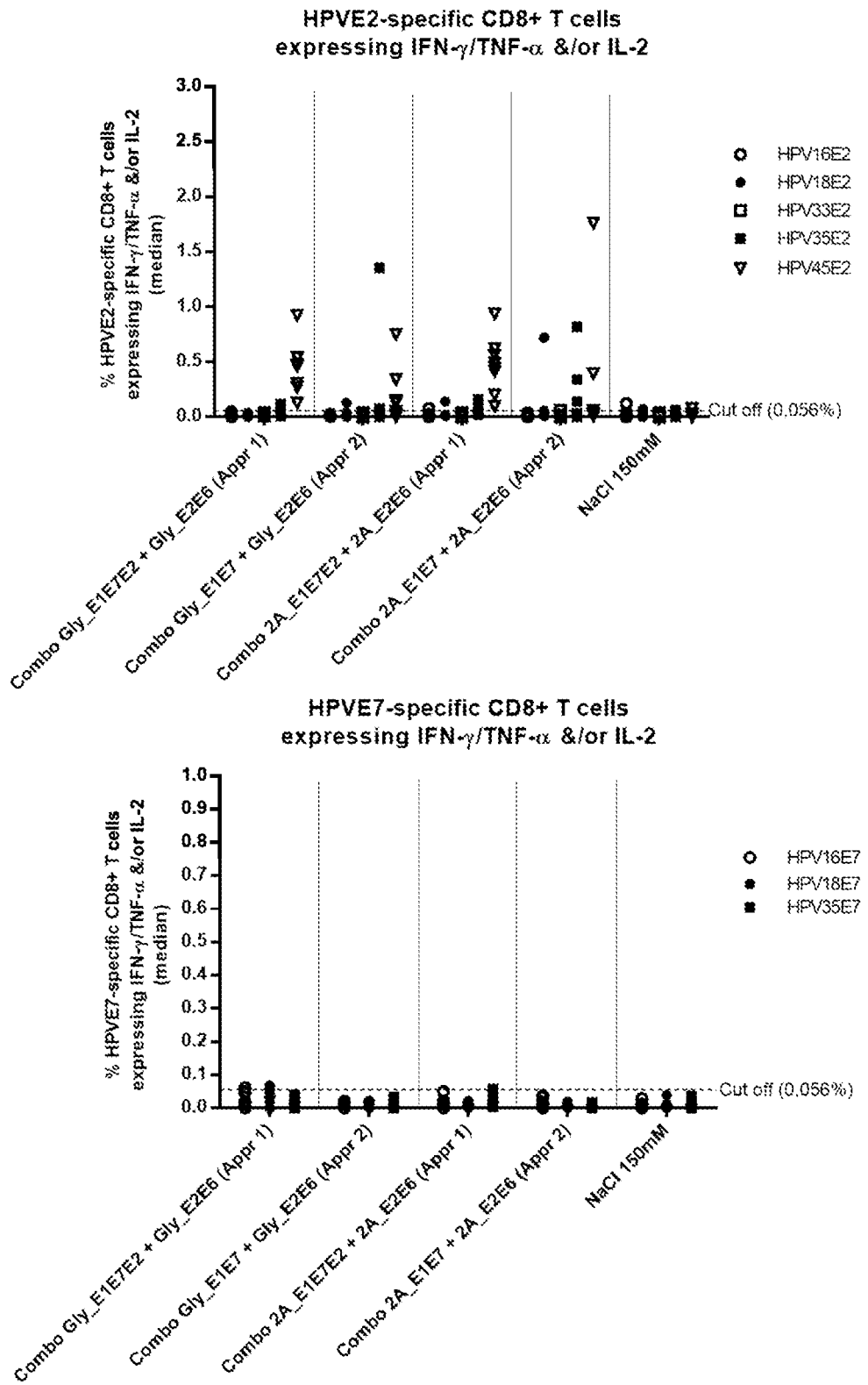

FIG. 29—HPV-specific and cross reactive CD8+ T cell responses elicited by ChAd155 vectors in CB6F1 inbred mice. Percentage of HPV-E1, E2, E6 and E7-specific and cross reactive CD8+ T cells secreting IFN-γ and/or IL-2 and/or TNF-α measured for several high risk HPV types at 21 days post second immunization. Intracellular staining was performed on splenocytes after a 6-hour re-stimulation with pools of HPV-derived 15mer peptides overlapping by 11AA covering the whole amino acid sequences of HPV16/18 E1/E2/E6/E7 and HPV35 E7 or the antigen-designed sequences of HPV33/35/45 E1/E2/E6. Data are shown for each individual mice and the median is represented by the red line in the graphs.

Figure 30:
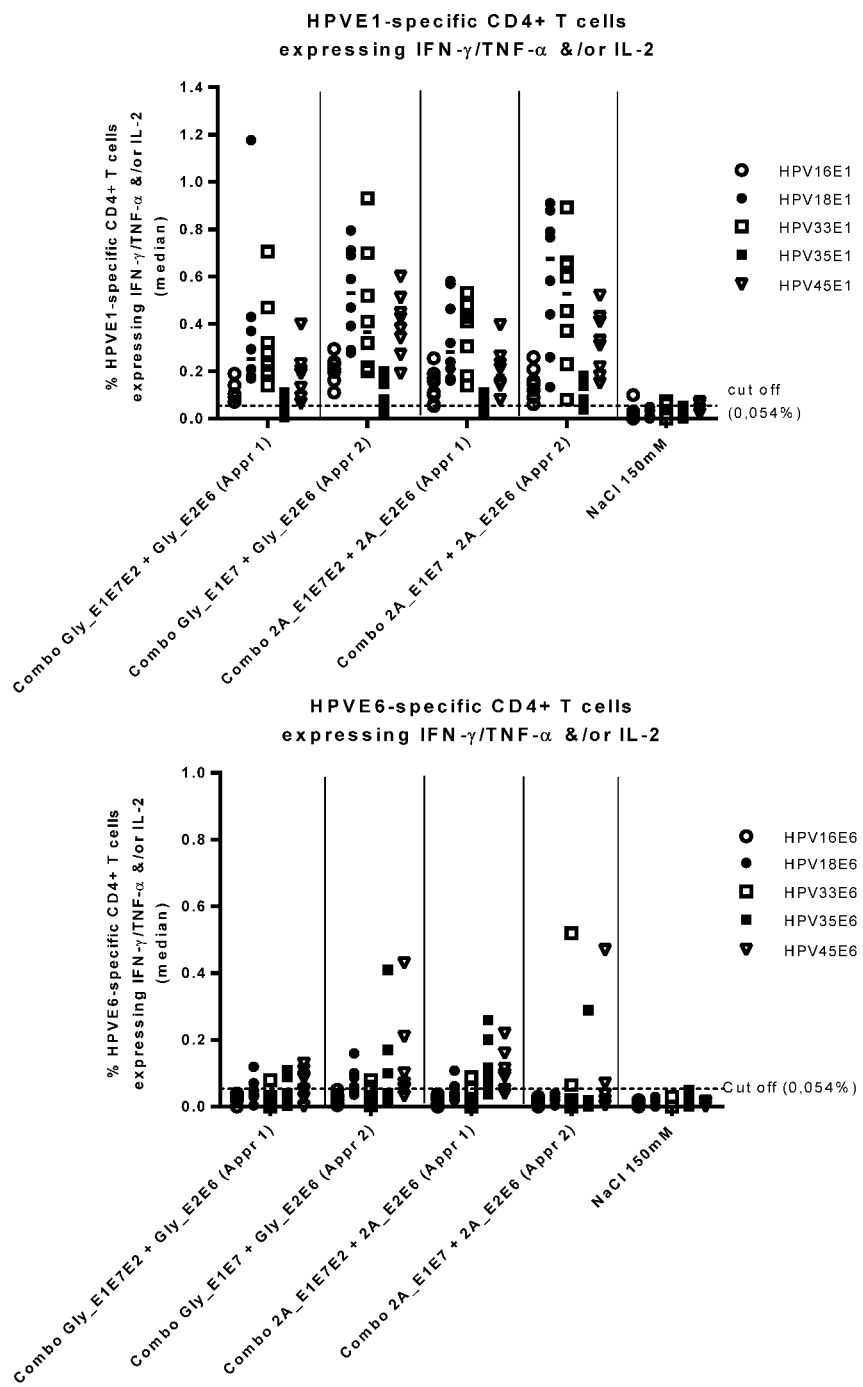
Figure 30:
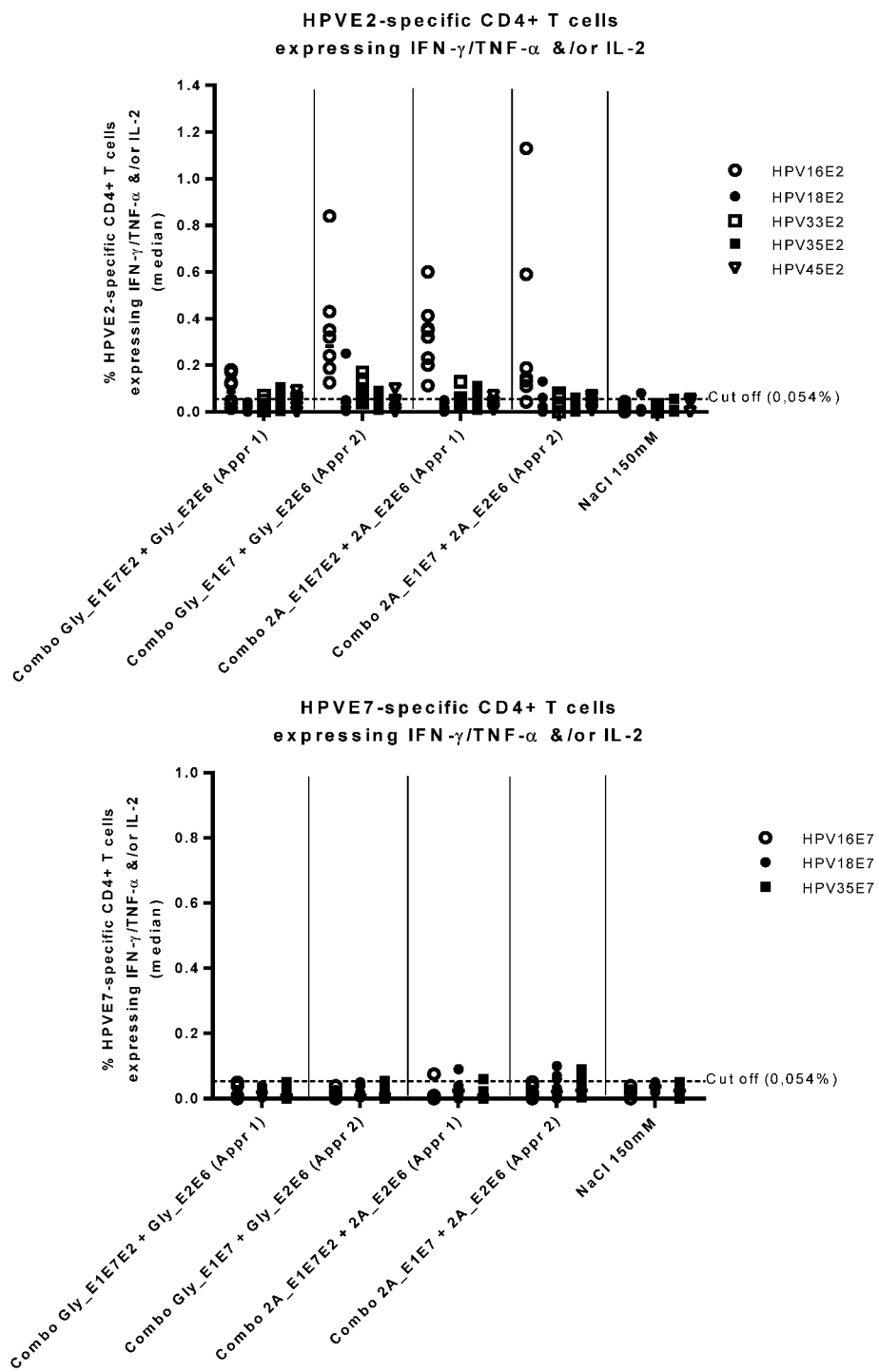

FIG. 30—HPV-specific and cross reactive CD4+ T cell responses elicited by ChAd155 vectors in CB6F1 inbred mice. Percentage of HPV-E1, E2, E6 and E7-specific and cross reactive CD4+ T cells secreting IFN-γ and/or IL-2 and/or TNF-α measured for several high risk HPV types at 21 days post second immunization. Intracellular staining was performed on splenocytes after a 6-hour re-stimulation with pools of HPV-derived 15mer peptides overlapping by 11AA covering the whole amino acid sequences of HPV16/18 E1/E2/E6/E7 and HPV35 E7 or the antigen-designed sequences of HPV33/35/45 E1/E2/E6. Data are shown for each individual mice and the median is represented by the red line in the graphs.

Figure 31:
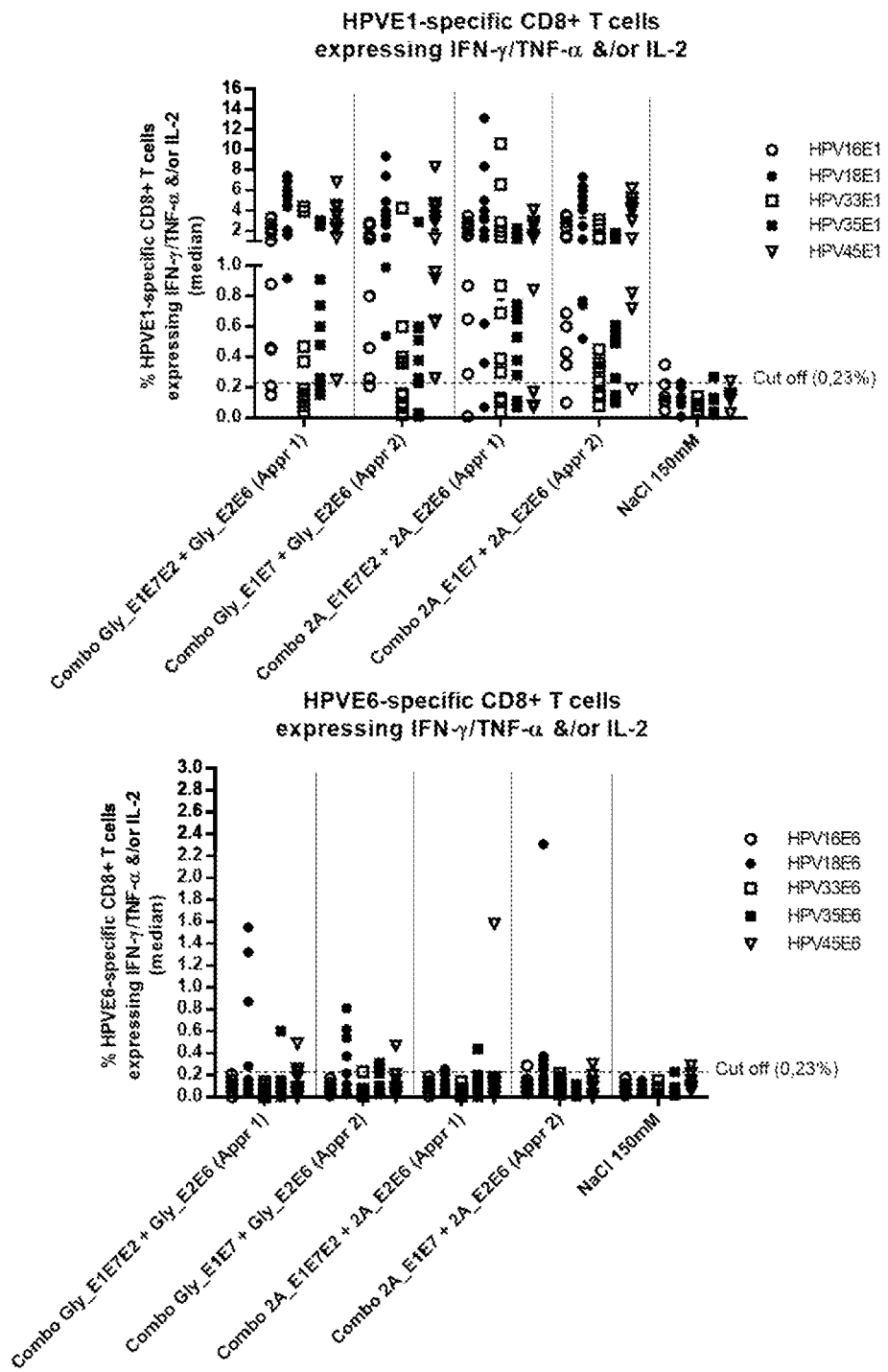
Figure 31:
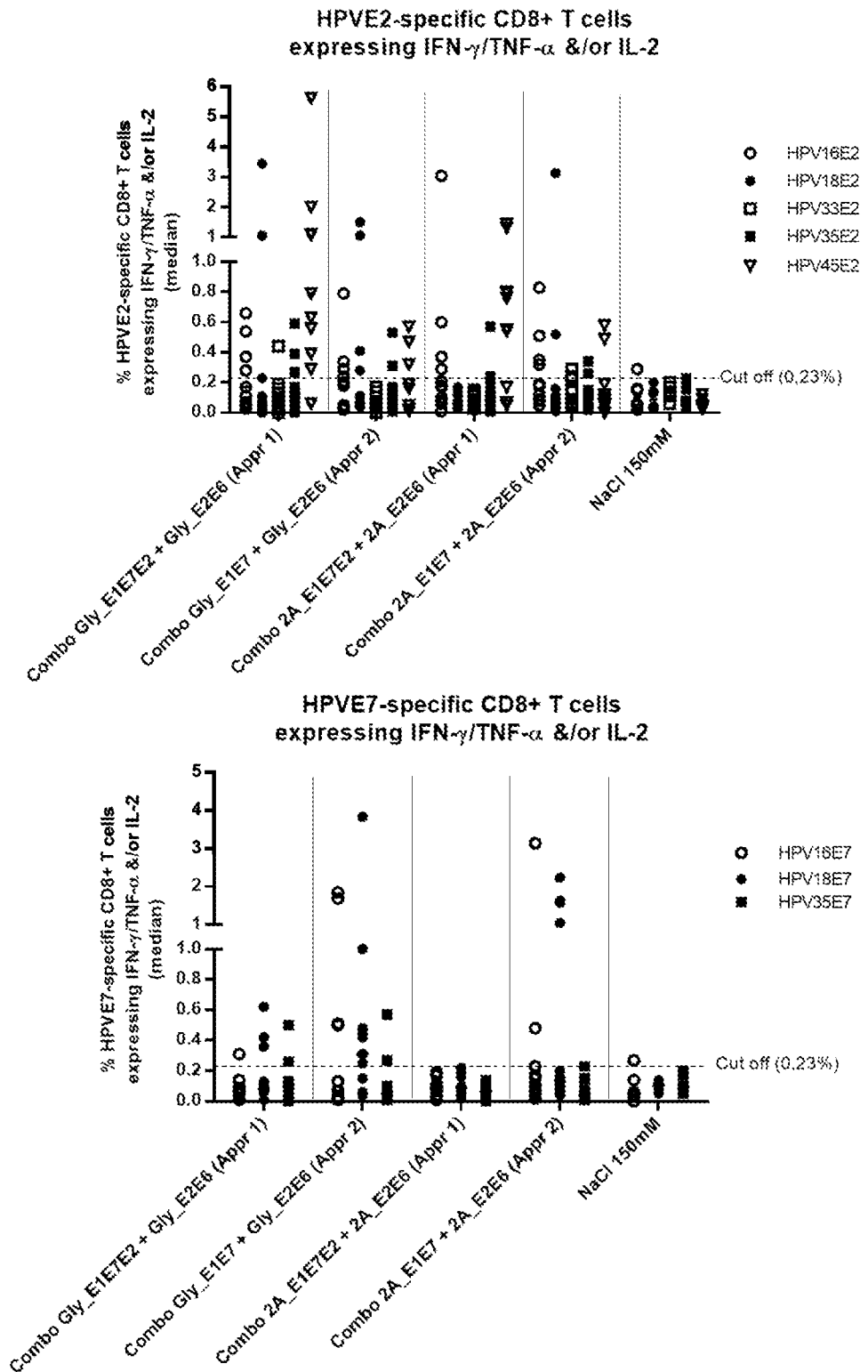

FIG. 31—HPV-specific and cross reactive CD8+ T cell responses elicited by ChAd155 vectors in CD-1 outbred mice. Percentage of HPV-E1, E2, E6 and E7-specific and cross reactive CD8+ T cells secreting IFN-γ and/or IL-2 and/or TNF-α measured for several high risk HPV types at 21 days post second immunization. Intracellular staining was performed on splenocytes after a 6-hour re-stimulation with pools of HPV-derived 15mer peptides overlapping by 11AA covering the whole amino acid sequences of HPV16/18 E1/E2/E6/E7 and HPV35 E7 or the antigen-designed sequences of HPV33/35/45 E1/E2/E6. Data are shown for each individual mice and the median is represented by the red line in the graphs.

Figure 32:
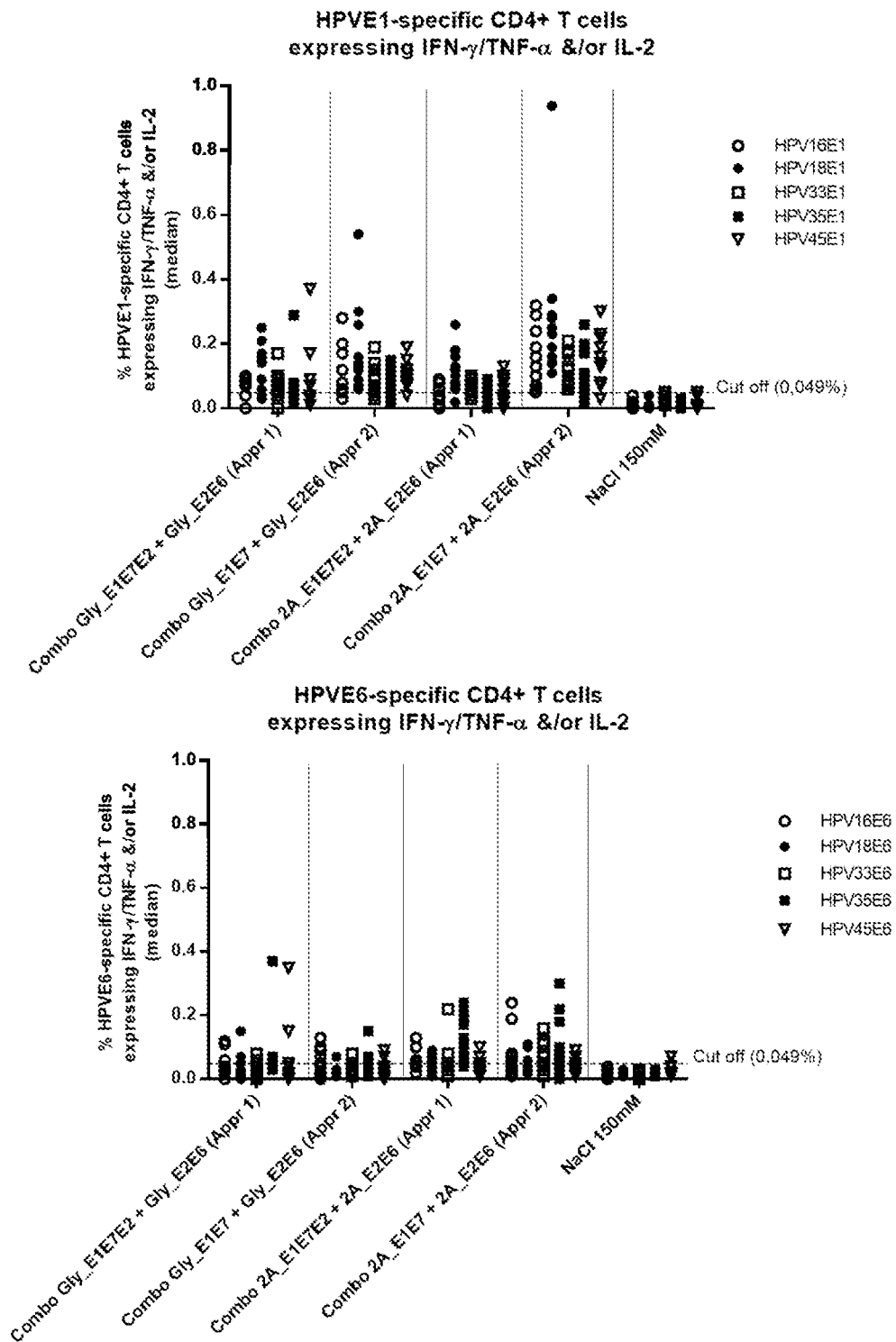
Figure 32:
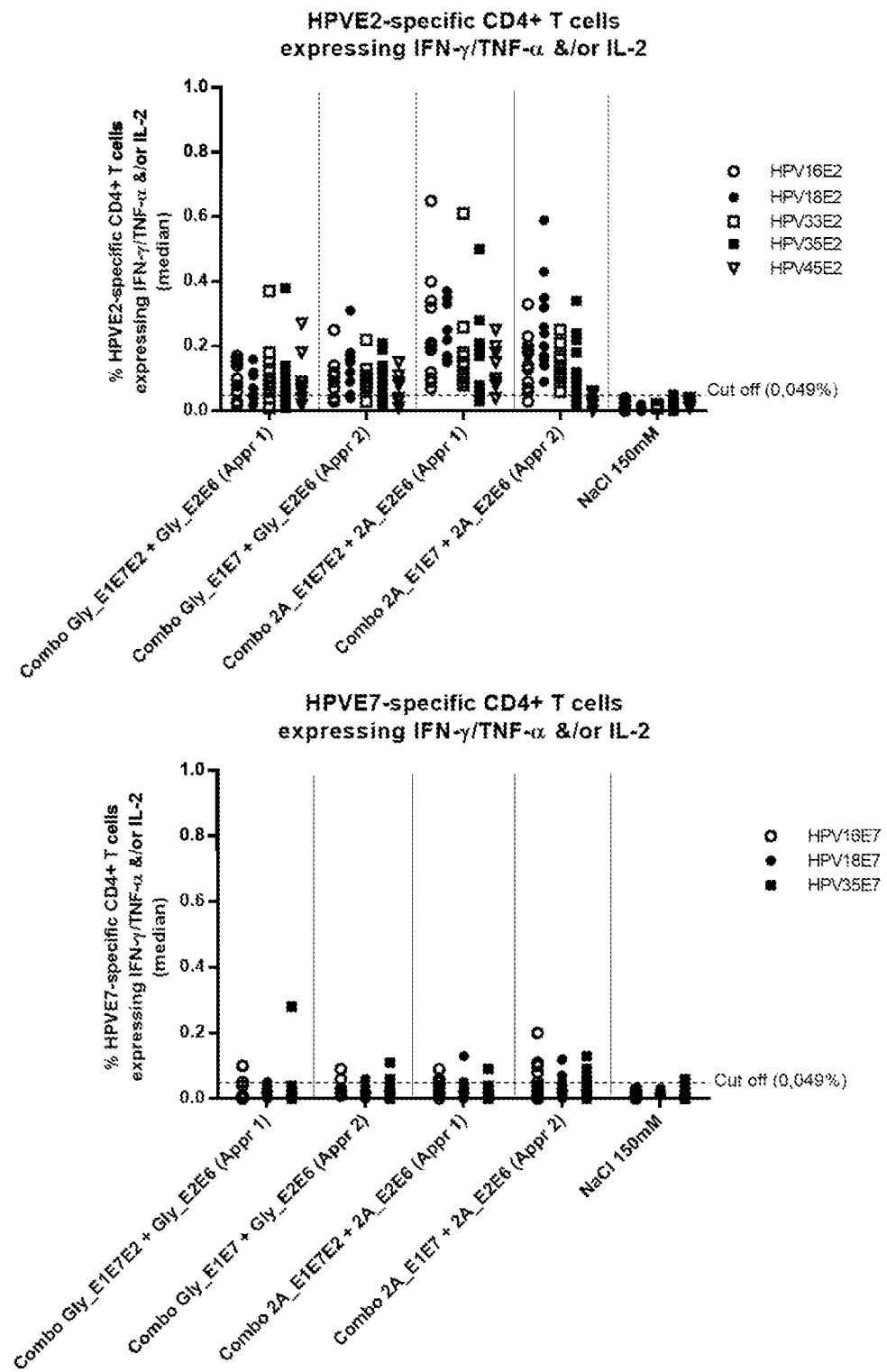

FIG. 32—HPV-specific and cross reactive CD4+ T cell responses elicited by ChAd155 vectors in CD-1 outbred mice. Percentage of HPV-E1, E2, E6 and E7-specific and cross reactive CD4+ T cells secreting IFN-γ and/or IL-2 and/or TNF-α measured for several high risk HPV types at 21 days post second immunization. Intracellular staining was performed on splenocytes after a 6-hour re-stimulation with pools of HPV-derived 15mer peptides overlapping by 11AA covering the whole amino acid sequences of HPV16/18 E1/E2/E6/E7 and HPV35 E7 or the antigen-designed sequences of HPV33/35/45 E1/E2/E6. Data are shown for each individual mice and the median is represented by the red line in the graphs.

Figure 33:
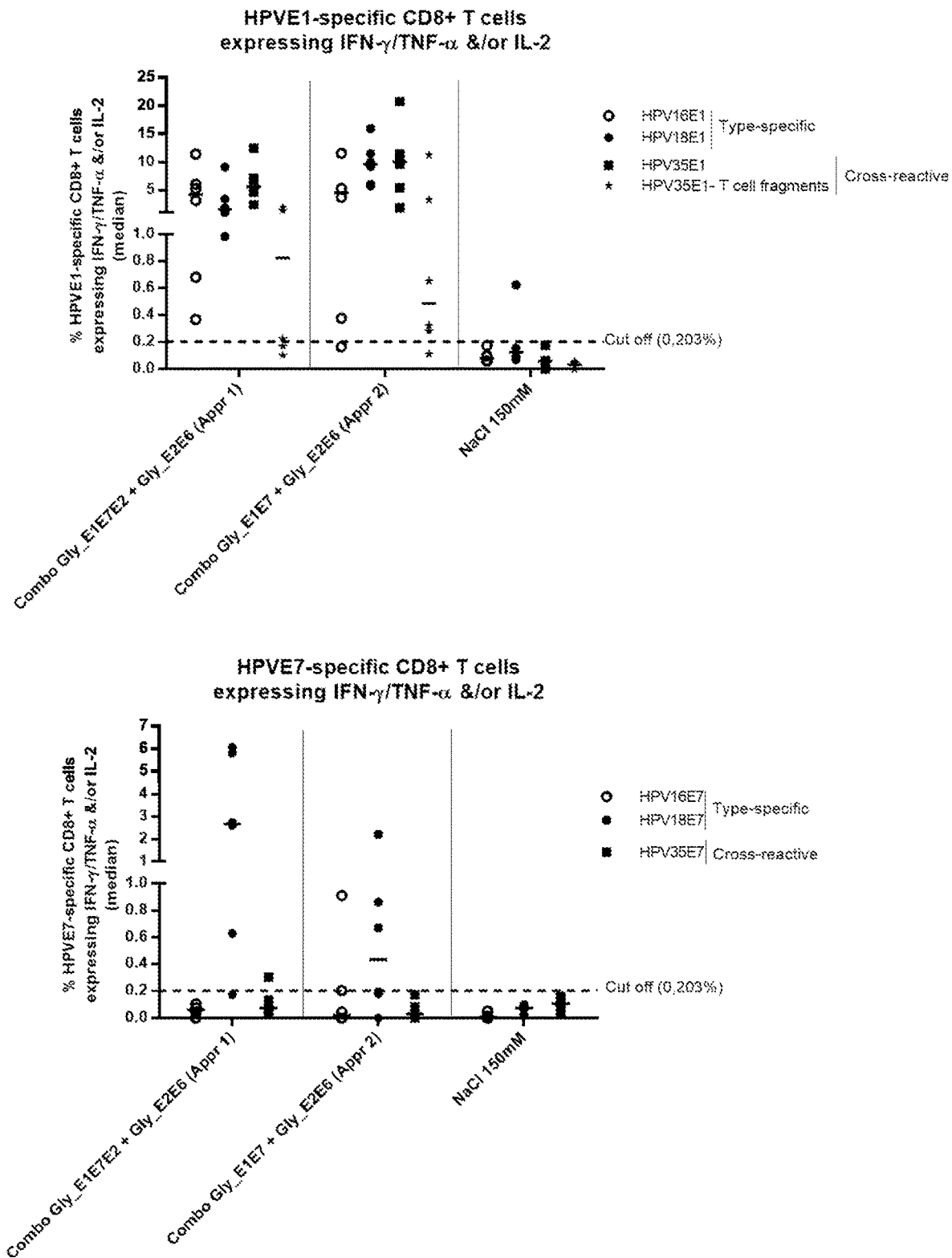
Figure 33:
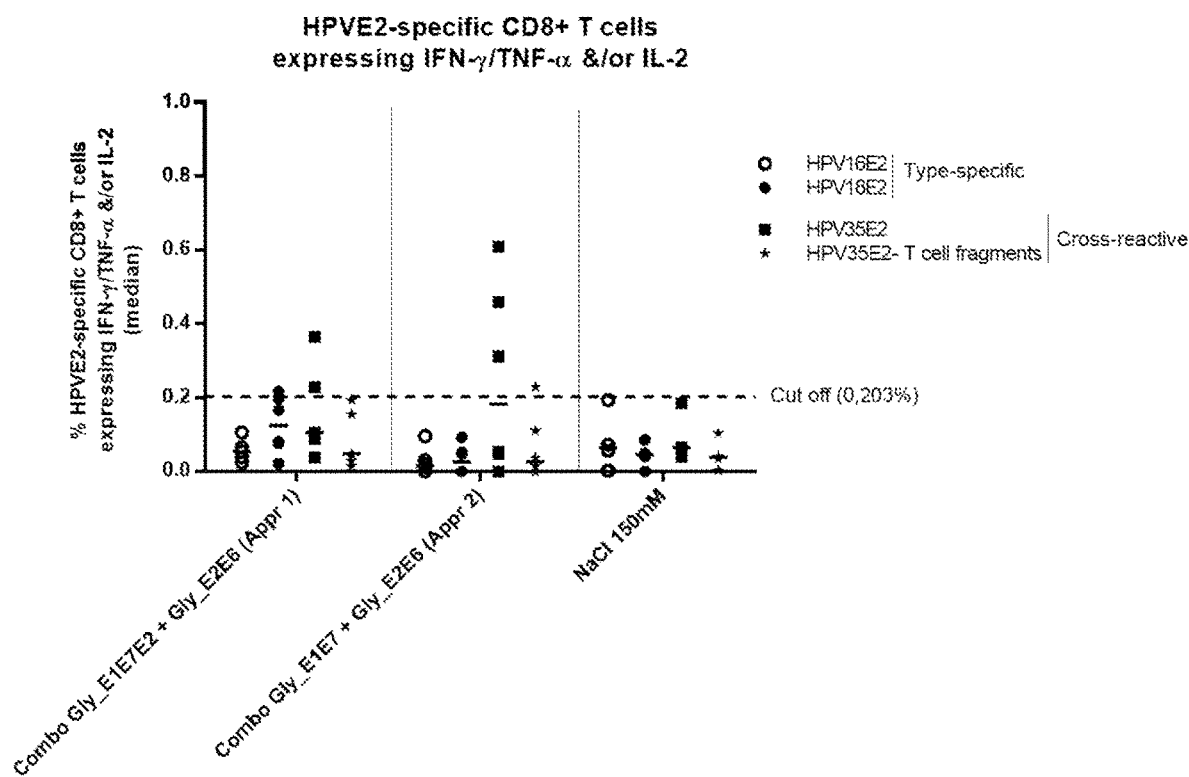

FIG. 33—HPV-specific and cross reactive CD8+ T cell responses elicited by ChAd155 vectors in HLA A2/DR1 transgenic inbred mice. Percentage of HPV-E1, E2 and E7-specific and cross reactive CD8+ T cells secreting IFN-γ and/or IL-2 and/or TNF-α measured for several high risk HPV types at 21 days post second immunization. Intracellular staining was performed on splenocytes after a 6-hour re-stimulation with pools of HPV-derived 15mer peptides overlapping by 11AA covering the whole amino acid sequences of HPV16/18 E1/E2/E7 and HPV35 E7, covering the antigen-designed sequences of HPV35 E1/E2 or covering the predicted human CD8+ T cell epitopes enriched regions of HPV35 E1/E2 (HPV35E1/2 T-cell fragments). Data are shown for each individual pool of two mice and the median is represented by the red line in the graphs.

Figure 34:
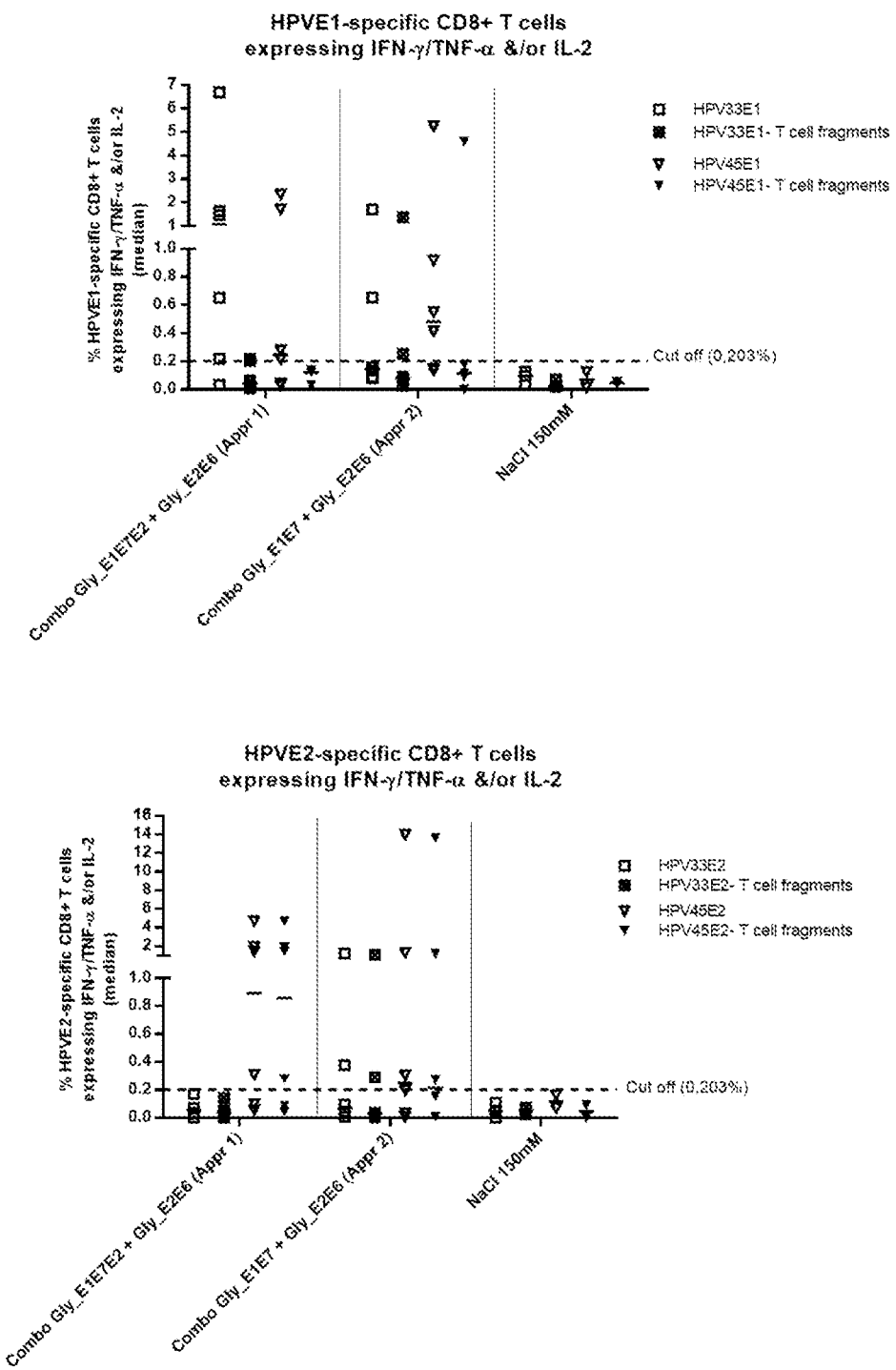

FIG. 34—HPV-specific and cross reactive CD8+ T cell responses elicited by ChAd155 vectors in HLA A2/DR1 transgenic inbred mice. Percentage of HPV-E1 and E2-specific and cross reactive CD8+ T cells secreting IFN-γ and/or IL-2 and/or TNF-α measured for several high risk HPV types at 21 days post second immunization. Intracellular staining was performed on splenocytes after a 6-hour re-stimulation with pools of HPV-derived 15mer peptides overlapping by 11AA covering the antigen-designed sequences of HPV33/45 E1/E2 or covering the predicted human CD8+ T cell epitopes enriched regions of HPV33/45 E1/E2 (HPV33/45 E1/2 T-cell fragments). Data are shown for each individual pool of two mice and the median is represented by the red line in the graphs.

Figure 35:
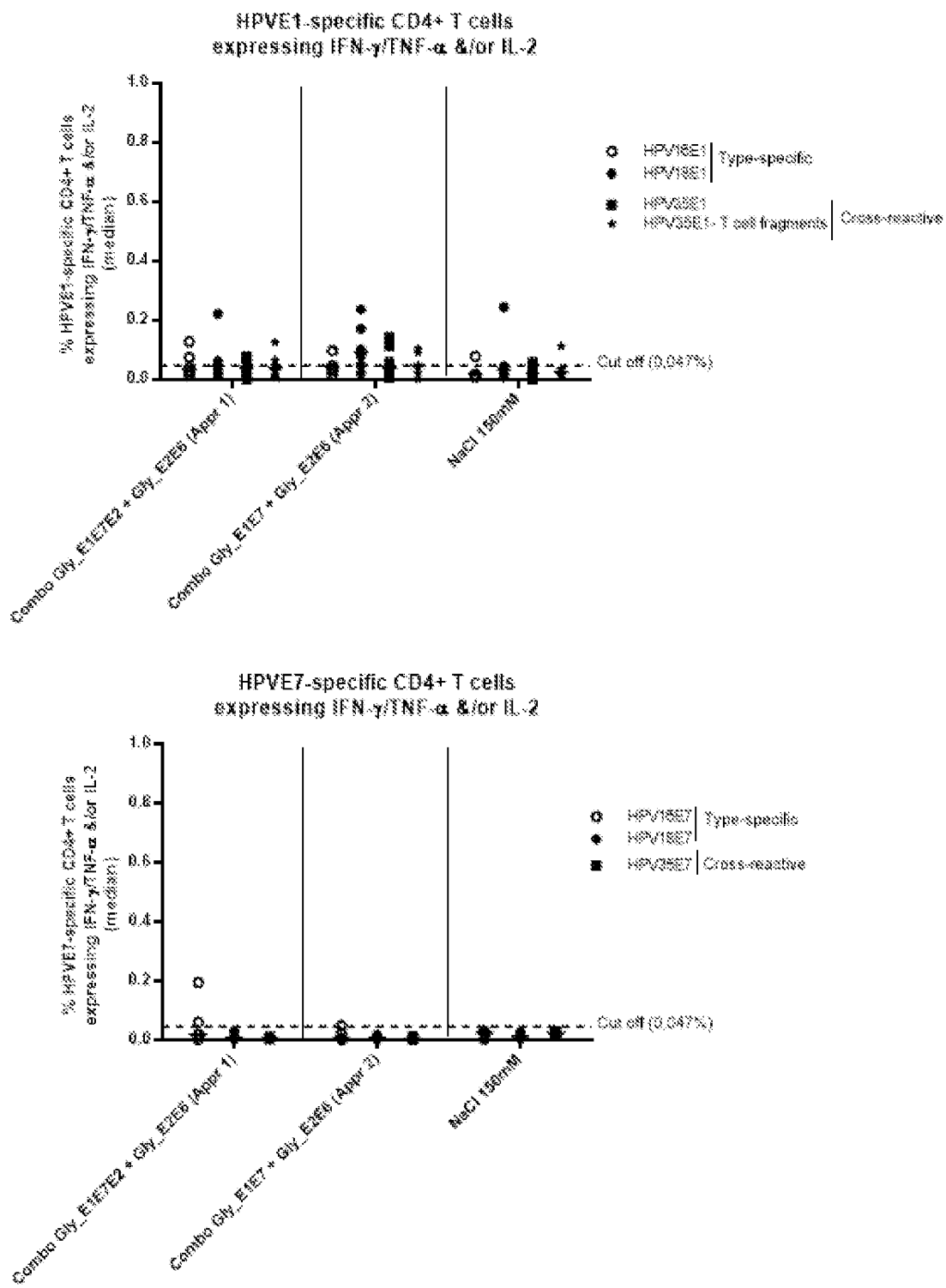
Figure 35:
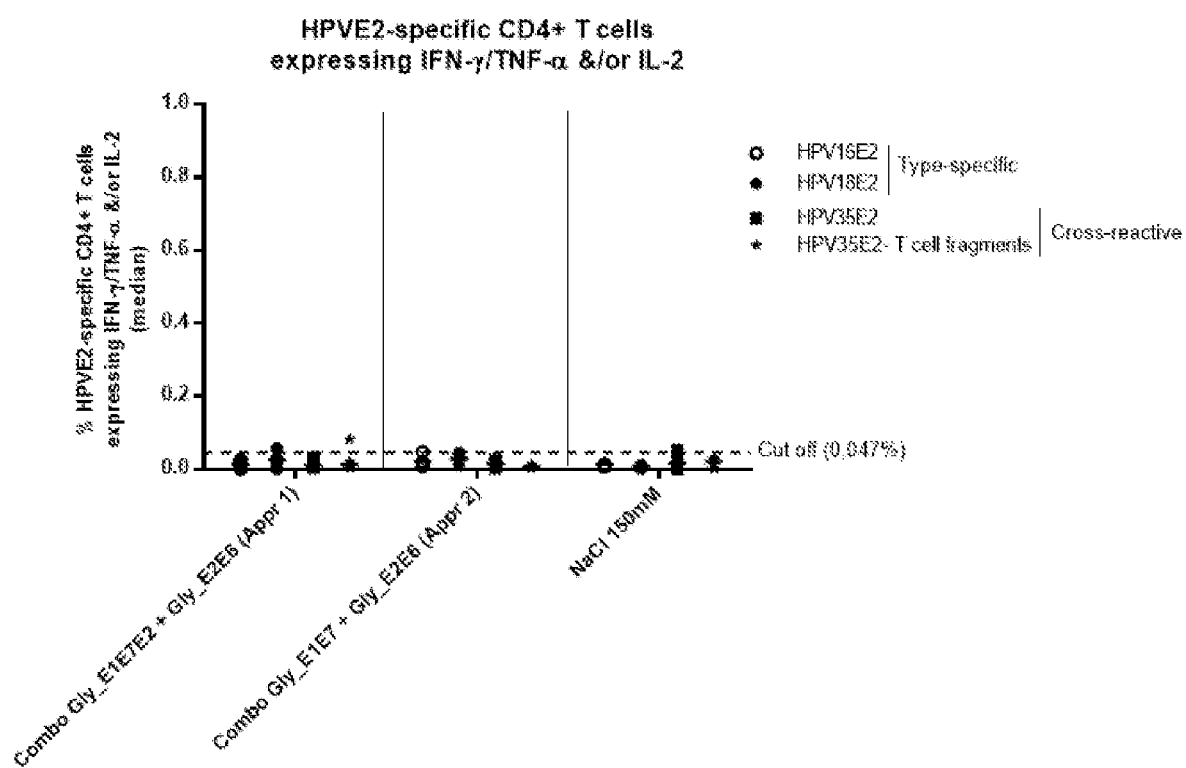

FIG. 35—HPV-specific and cross reactive CD4+ T cell responses elicited by ChAd155 vectors in HLA A2/DR1 transgenic inbred mice. Percentage of HPV-E1, E2 and E7-specific and cross reactive CD4+ T cells secreting IFN-γ and/or IL-2 and/or TNF-α measured for several high risk HPV types at 21 days post second immunization. Intracellular staining was performed on splenocytes after a 6-hour re-stimulation with pools of HPV-derived 15mer peptides overlapping by 11AA covering the whole amino acid sequences of HPV16/18 E1/E2/E7 and HPV35 E7, covering the antigen-designed sequences of HPV35 E1/E2 or covering the predicted human CD8+ T cell epitopes enriched regions of HPV35 E1/E2 (HPV35E1/2 T-cell fragments). Data are shown for each individual pool of two mice and the median is represented by the red line in the graphs.

FIG. 36—HPV-specific and cross reactive CD4+ T cell responses elicited by ChAd155 vectors in HLA A2/DR1 transgenic inbred mice. Percentage of HPV-E1 and E2-specific and cross reactive CD4+ T cells secreting IFN-γ and/or IL-2 and/or TNF-α measured for several high risk HPV types at 21 days post second immunization. Intracellular staining was performed on splenocytes after a 6-hour re-stimulation with pools of HPV-derived 15mer peptides overlapping by 11AA covering the antigen-designed sequences of HPV33/45 E1/E2 or covering the predicted human CD8+ T cell epitopes enriched regions of HPV33/45 E1/E2 (HPV33/45 E1/2 T-cell fragments). Data are shown for each individual pool of two mice and the median is represented by the red line in the graphs.

FIG. 37—Diagrams nucleotide insert constructs (A) Gly_E2$^7$E7$^2$, (B) Gly_E1E6$^7$E1 and (C) Gly_E1$^2$E6$^7$ Double lines indicate the position of the 5×Gly. (Fragments of HPV proteins are not drawn to scale). "Gly" indicates the presence of either the 5×Gly linker.

FIG. 38—SAM-HPV constructs. The SAM background consists of VEE TC-83 replicon encoding the viral non-structural proteins 1-4 (nsP1-4), followed by the subgenomic promoter, and a transgene encoding antigenic HPV polypeptides. The empty vector is shown in SEQ ID NO:1.

FIG. 39—Diagrams of nucleotide insert constructs (A) Gly_E2$^4$, (B) Gly_E2$^3$E7$^2$ and (C) Gly_E1$^2$E6$^7$ Double lines indicate the position of the 5×Gly. (Fragments of HPV proteins are not drawn to scale). "Gly" indicates the presence of either the 5×Gly linker.

DESCRIPTION OF THE SEQUENCES

SEQ ID NO: 1—ChAd155 Fiber (amino acid)
SEQ ID NO: 2—ChAd155 Fiber (nucleotide)
SEQ ID NO: 3—ChAd155 Penton (amino acid)
SEQ ID NO: 4—ChAd155 Penton (nucleotide)
SEQ ID NO: 5—ChAd155 Hexon (amino acid)
SEQ ID NO: 6—ChAd155 Hexon (nucleotide)
SEQ ID NO: 7—Modified backbone ChAd155 #1434 (nucleotide)
SEQ ID NO: 8—Modified backbone ChAd155 #1390 (nucleotide)
SEQ ID NO: 9—Modified backbone ChAd155 #1375 (nucleotide)
SEQ ID NO: 10—ChAd155 wild type (nucleotide)
SEQ ID NO: 11—Polynucleotide sequence encoding ChAd155+RSV transgene
SEQ ID NO: 12—CASI promoter (nucleotide)
SEQ ID NO: 13—Ad5orf6 primer 1 (nucleotide)
SEQ ID NO: 14—Ad5orf6 primer 2 (nucleotide)
SEQ ID NO: 15—BAC/ChAd155 ΔE1_TetO hCMV RpsL-Kana primer 1 (nucleotide)
SEQ ID NO: 16—BAC/ChAd155 ΔE1_TetO hCMV RpsL-Kana primer 2 (nucleotide)
SEQ ID NO: 17-1021-FW E4 Del Step1 primer (nucleotide)
SEQ ID NO: 18—1022-RW E4 Del Step1 primer (nucleotide)
SEQ ID NO: 19-1025-FW E4 Del Step2 primer (nucleotide)
SEQ ID NO: 20—1026-RW E4 Del Step2 primer (nucleotide)
SEQ ID NO: 21-91-SubMonte FW primer (nucleotide)
SEQ ID NO: 22-890-BghPolyA RW primer (nucleotide)
SEQ ID NO: 23—CMVfor primer (nucleotide)
SEQ ID NO: 24—CMVrev primer (nucleotide)
SEQ ID NO: 25—CMVFAM-TAMRA qPCR probe (nucleotide)
SEQ ID NO: 26—Woodchuck Hepatitis Virus Post-transcriptional Regulatory Element (WPRE) (Nucleotide)
SEQ ID NO: 27—ChAd3 Fiber (amino acid)
SEQ ID NO: 28—PanAd3 Fiber (amino acid)
SEQ ID NO: 29—ChAd17 Fiber (amino acid)
SEQ ID NO: 30—ChAd19 Fiber (amino acid)
SEQ ID NO: 31—ChAd24 Fiber (amino acid)
SEQ ID NO: 32—ChAd11 Fiber (amino acid)
SEQ ID NO: 33—ChAd20 Fiber (amino acid)
SEQ ID NO: 34—ChAd31 Fiber (amino acid)
SEQ ID NO: 35—PanAd1 Fiber (amino acid)
SEQ ID NO: 36—Pan Ad2 Fiber (amino acid)
SEQ ID NO: 37—RSV FATM-N-M2-1 amino acid sequence
SEQ ID NO: 38—HIV Gag (nucleotide)
SEQ ID NO: 39—HPV16-E1 full length sequence
SEQ ID NO: 40—HPV16-E2 full length sequence
SEQ ID NO: 41—HPV16-E6 full length sequence
SEQ ID NO: 42—HPV16-E7 Full length sequence
SEQ ID NO: 43—HPV16 E1 fragments aa14-90+aa211-622
SEQ ID NO: 44—HPV16 E2 fragments aa1-138+aa150-210+aa260-365
SEQ ID NO: 45—HPV16 E6 fragment aa 8-147
SEQ ID NO: 46-2A sequence (nucleotide)
SEQ ID NO: 47-2A sequence (amino acid)
SEQ ID NO: 48-5×Gly linker
SEQ ID NO: 49—Concatenated full length HPV16 E1, E2, E6
SEQ ID NO:50—Concatenated fragments of E1, E2 and E6+initial methionine
SEQ ID NO:51—HPV16 E1 aa203-622 with G482D substitution
SEQ ID NO:52—HPV18 E1 aa203-622 with G482D substitution
SEQ ID NO:53—HPV16 E2 (AA1-201+GGTGGS linker between tad and dbd domain)+(aa285-365) with K111A mutation
SEQ ID NO:54—HPV18 E2 (AA1-201+GGTGGS linker between tad and dbd domain)+(aa285-365) with K111A mutation)
SEQ ID NO:55—HPV51 E2 (AA1-201+GGTGGS linker between tad and dbd domain+aa285-365) with K111A mutation
SEQ ID NO:56—HPV16 E6: aa11-150, with F54R and C110R substitutions
SEQ ID NO:57—HPV18 E6: aa11-150, with F54R and C110R substitutions
SEQ ID NO:58—HPV 58 E6: aa11-150, with F54R and C110R substitution
SEQ ID NO:59—HPV 56 E6: aa11-150, with F54R and C110R substitutions
SEQ ID NO:60—HPV 73 E6: aa11-150, with F54R and C110R substitutions
SEQ ID NO:61—HPV 16 E7: aa49-98+aa7-28, C24G and E26Q substitutions SEQ ID NO:62—HPV 18 E7: aa49-98+aa7-28, C24G and E26Q substitutions
SEQ ID NO:63—Gly_E2³E6⁵E1²E7²
SEQ ID NO:64—Gly_E2³E6⁵
SEQ ID NO:65—Gly_E1²E7²+initial Met
SEQ ID NO:66-2A_E2³E6⁵
SEQ ID NO:67-2A_E1²E7²+initial Met
SEQ ID NO:68—HPV16 E1 aa 203-622
SEQ ID NO:69—HPV18 E1 aa 203-622
SEQ ID NO:70—HPV33 E1 aa 203-622
SEQ ID NO:71—HPV16 E2: AA1-201+GGTGGS linker+aa285-365
SEQ ID NO:72—HPV 18 E2: AA1-201+GGTGGS linker+aa285-365
SEQ ID NO:73—HPV 31 E2: AA1-201+GGTGGS linker+aa285-365
SEQ ID NO:74—HPV 33 E2: AA1-201+GGTGGS linker+aa285-365
SEQ ID NO:75—HPV45 E2: AA1-201+GGTGGS linker+aa285-365
SEQ ID NO:76—HPV52 E2: AA1-201+GGTGGS linker+aa285-365
SEQ ID NO:77—HPV58 E2: AA1-201+GGTGGS linker+aa285-365
SEQ ID NO:78—HPV 16 E6: aa1 1-150
SEQ ID NO:79—HPV 18 E6: aa11-150
SEQ ID NO:80—HPV 31 E6: aa11-150
SEQ ID NO:81—HPV 33 E6: aa11-150
SEQ ID NO:82—HPV 45 E6: aa11-150
SEQ ID NO:83—HPV 52 E6: aa11-150
SEQ ID NO:84—HPV 58 E6: aa11-150
SEQ ID NO:85—Gly_E1³E7²E2³+initial Methionine
SEQ ID NO:86-2A_E1³E7²E2³+initial Methionine
SEQ ID NO:87—Gly_E2⁴E6⁷
SEQ ID NO:88-2A_E2⁴E6⁷
SEQ ID NO:89—HPV 31 E1 corresponding to aa203-622 of HPV16 E1
SEQ ID NO: 90—HPV 45 E1 fragment corresponding to aa203-622 of HPV16 E1
SEQ ID NO: 91—Gly_E1⁵E7²+Initial Methionine
SEQ ID NO: 92-2A_E1⁵E7²+Initial Methionine
SEQ ID NO: 93—Gly_E2⁵E6⁶
SEQ ID NO: 94-2A_E2⁵E6⁶
SEQ ID NO:95—linker of GGTGGS
SEQ ID NO:96—2A consensus motif Asp-Val/Ile-Glu-X-Asn-Pro-Gly-Pro
SEQ ID NO:97—First 109 amino acids of Protein D
SEQ ID NO: 98—HPV35 E1 fragment corresponding to aa203-622 of HPV16 E1
SEQ ID NO: 99—HPV35 E6 fragment corresponding to aa11-150 of HPV16E6
SEQ ID NO: 100—HPV18 E2 fragment (aa 1-206+286-365 of full length HPV18 E2)
SEQ ID NO: 101—HPV45 E2 fragment (aa 1-208+290-368 of full length HPV45 E2)
SEQ ID NO: 102—HPV35 E2 fragment (aa 1-202+287-367 of full length HPV35 E2)
SEQ ID NO: 103—HPV33 E2 fragment (aa 1-201+273-353 of full length HPV33 E2)
SEQ ID NO: 104—HPV16 E1 CD4 T cell enriched fragment (aa 210-320+485-580 of full length HPV 16 E1)
SEQ ID NO: 105—HPV18 E1 CD4 T cell enriched fragment (aa 217-327+492-587 of full length HPV 18 E1)
SEQ ID NO: 106—HPV45 E1 CD4 T cell enriched fragment (aa 203-313+478-573 of full length HPV 45 E1)
SEQ ID NO: 107—HPV35 E1 CD4 T cell enriched fragment (aa 196-306+471-566 of full length HPV 35 E1)
SEQ ID NO: 108—HPV33 E1 CD4 T cell enriched fragment (aa 203-313+478-573 of full length HPV 33 E1)
SEQ ID NO: 109—HPV16 E2 CD4 T cell enriched fragment (aa 60-150 of full length HPV 16 E2)
SEQ ID NO: 110—HPV18 E2 CD4 T cell enriched fragment (aa 64-155 of full length HPV 18 E2)
SEQ ID NO: 111—HPV45 E2 CD4 T cell enriched fragment (aa 66-157 of full length HPV 45 E2)
SEQ ID NO: 112—HPV35 E2 CD4 T cell enriched fragment (aa 61-151 of full length HPV 35 E2)
SEQ ID NO: 113—HPV33 E2 CD4 T cell enriched fragment (aa 60-150 of full length HPV 33 E2)
SEQ ID NO: 114—HPV16-E1 DNA sequence
SEQ ID NO: 115—HPV16-E2 DNA sequence
SEQ ID NO: 116—HPV16-E6 DNA sequence
SEQ ID NO: 117—Concatenated full length HPV16 E1, E2, E6 DNA sequence
SEQ ID NO: 118—Concatenated fragments of E1, E2 and E6+initial methionine DNA sequence
SEQ ID NO: 119—Gly_E2³E6⁵E1²E7² DNA sequence
SEQ ID NO: 120—Gly_E2³E6⁵ DNA sequence
SEQ ID NO: 121—Gly_E1²E7²+initial Met DNA sequence
SEQ ID NO: 122-2A_E2³E6⁵DNA sequence
SEQ ID NO: 123-2A_E1²E7²+initial Met DNA sequence
SEQ ID NO: 124—Gly_E1³E7²E2³+initial Methionine DNA sequence
SEQ ID NO: 125-2A_E1³E7²E2³+initial Methionine DNA sequence
SEQ ID NO: 126—Gly_E2⁴E6⁷DNA sequence
SEQ ID NO: 127-2A_E2⁴E6⁷ DNA sequence
SEQ ID NO: 128—Gly_E1⁵E7²+Initial Methionine DNA sequence
SEQ ID NO: 129-2A_E1⁵E7²+Initial Methionine DNA sequence
SEQ ID NO: 130—Gly_E2⁵E6⁶DNA sequence
SEQ ID NO: 131-2A_E2⁵E6⁶DNA sequence
SEQ ID NO: 132—Gly_E1³E7²E2³ with mutations
SEQ ID NO: 133—Gly_E2⁴E6⁷ with mutations
SEQ ID NO: 134—Gly_E2⁷E7² with mutations
SEQ ID NO: 135—Gly_E1 E6⁷E1 with mutations
SEQ ID NO: 136—Gly_E1²E6⁷ with mutations
SEQ ID NO: 137—Gly_E1³E7²E2³ DNA sequence (with mutations)
SEQ ID NO: 138—Gly_E2⁴E6⁷ DNA sequence (with mutations)
SEQ ID NO: 139—Gly_E2⁷E7² DNA sequence (with mutations)
SEQ ID NO: 140—Gly_E1 E6⁷E1 DNA sequence (with mutations)
SEQ ID NO: 141—Gly_E1²E6⁷ DNA sequence (with mutations)
SEQ ID NO:142—Sequence for empty SAM vector.
SEQ ID NO:143—E2 SAM insert polypeptide sequence
SEQ ID NO:144—E2 SAM insert polynucleotide sequence
SEQ ID NO:145—E2E7 SAM insert polypeptide sequence
SEQ ID NO:146—E2E7 SAM insert polynucleotide sequence
SEQ ID NO:147—E1E6_SAM insert polypeptide sequence
SEQ ID NO:148—E1E6_SAM insert polynucleotide sequence
SEQ ID NO:149—SAM E2 vector DNA sequence
SEQ ID NO:150—SAM E2 vector RNA sequence
SEQ ID NO:151—SAM E2E7 vector DNA sequence SEQ ID NO:152—SAM E2E7 vector RNA sequence
SEQ ID NO:153—SAM E1E6 vector DNA sequence
SEQ ID NO:154—SAM E1E6 vector DNA sequence

DETAILED DESCRIPTION

The present invention provides nucleic acid constructs capable of encoding HPV peptides useful in inducing a therapeutic immune response to persistent HPV infection, such as HPV infection of the cervical epithelium. The nucleic acid constructs are designed to encode antigenic HPV peptides capable of inducing a cross-reactive immune response in a subject against more than one high-risk HPV type. Adenoviral vectors capable of expressing the antigenic HPV peptides are also provided.

Human Papillomavirus (HPV)

Human Papillomavirus (HPV) is a non-enveloped deoxyribonucleic acid (DNA) virus, with a genome of double-stranded DNA encoding six early proteins (E1, E2, E4, E5, E6 and E7) and two late proteins (L1 and L2). HPV E1 and E2 proteins are required for replication of the virus. HPV E4 and E5 function in viral assembly and cellular proliferation. HPV E6 induces DNA synthesis and interacts with various cellular proteins and the tumor suppressor, p53. HPV E7 induces cell proliferation and interacts with cell cycle regulators and tumor suppressors, such as pRB. Both E6 and E7 are considered oncogenic due to their capacity to interfere with tumor suppressors and promote malignant transformation. Late proteins L1 and L2 provide viral structural proteins.

HPV establish productive infections within the stratified epithelia of the skin, and the mucosal epithelium of the anogenital tract and the oral cavity. HPVs can infect basal cells (the proliferating component of stratified epithelia). After basal cell division, daughter cells typically migrate into the suprabasal compartment and undergo terminal differentiation; HPV infection disturbs or prevents the differentiation of the epithelial cells, but continues to support DNA synthesis and cell proliferation. The circular viral DNA genome, normally harbored in the infected cell as a nuclear plasmid, may become integrated into the host genome, leading to up-regulation of the oncogenes HPV E6 and E7, and a growth advantage over other cells. Studies suggest that HPV E6 and E7 proteins are responsible for the malignant phenotype of cervical carcinoma cells.

Both E6 and E7 proteins are typically expressed in HPV-carrying anogenital malignant tumors. The progression of low-grade HPV cervical lesions to invasive cancer is associated with the integration of the HPV genome into the host chromosomes, the loss or disruption of E2 expression, and upregulation of E6 and E7 oncogene expression.

Pathology and Classification of HPV-Induced Lesions

Various systems exist for the classification of cervical dysplasia caused by HPV infection, e.g., the Bethesda System (Solomon (1990)) and the Cervical Intraepithelial Neoplasia (CIN) scale (Richart (1990)). Low-grade precursors of cervical cancer are known as CIN grade 1 (CIN scale) or low-grade squamous intraepithelial lesions (LSIL)(Bethesda system); these may progress to high-grade precursors (CIN grades 2 and 3/high-grade squamous intraepithelial lesions (HSIL)). Additionally, there is evidence that CIN3 can develop directly from infection by certain high-risk HPV types, without a stage of CIN1 or 2 (see, e.g., Winer et al., 2005). The 'grade' of CIN is based on the percentage of cells that are abnormal (dysplastic).

Studies suggest that many HPV infections become undetectable within 1-2 years. However, the duration of infection appears to be longer for high-risk HPV types compared to low-risk types. A study of longer-term infection with a median follow-up of 5.1 years (Schiffman et al., 2005) showed a longer persistence of HPV 16 compared with other HPV types.

Figure 12:
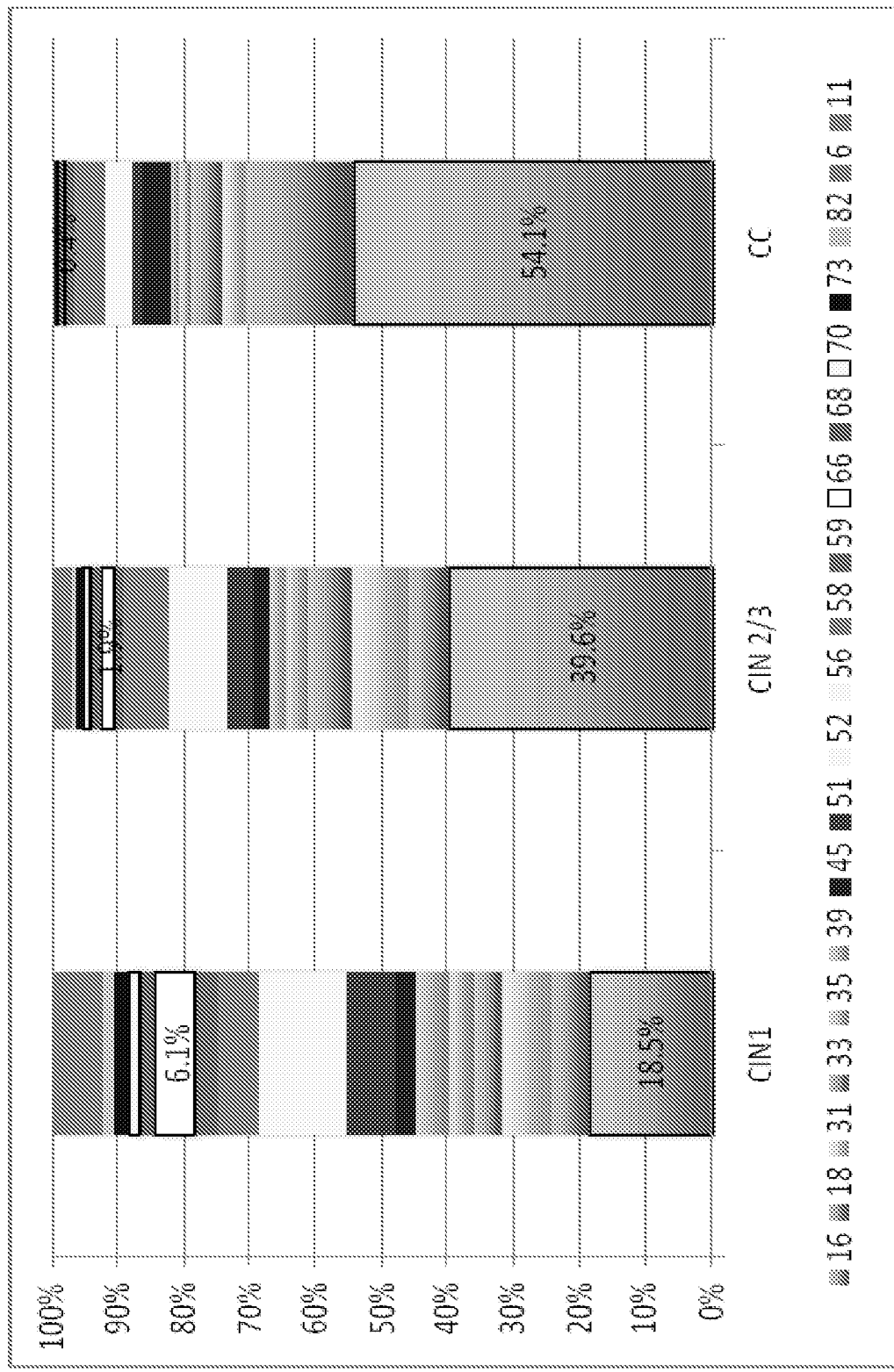
FIG. 12: percentage of HPV types in CIN1, CIN2/3 and CC (Cervical Cancer), taken from WHO/ICO 2010 summary report. HPV16 was found in 18.5% of CIN1, 39.6% of CIN2/3 and 54.1% of Cervical Cancer. In contrast, other HPV subtypes were more prevalent in CIN1 and less prevalent in Cervical Cancer lesions.

In cervical HPV infections, the relative frequency of different HPV types varies among the stages of cervical lesion. HPV16 has been found to be twice as prevalent in HSIL than in LSIL, for example. (See FIG. 12, taken from WHO/IC summary report, 2010). Other HPV types are found more often in LSIL (see, e.g., FIG. 12 showing 6.1% prevalence of HPV 66 in LSIL, and 0.4% in Cervical Cancer (CC)). See also IARC Monograph, vol. 90, pp. 193-194, Table 26.

Thus, among the HPV types known to infect human anogenital epithelial tissue, some are associated with a higher risk for progression to cervical cancer, compared to other HPV types. High risk HPV types (hrHPV) include: 16, 18, 31, 33, 35, 39, 45, 51, 52, 56, 58, 59, 68, 73, 82. In invasive cancers caused by HPV, high-risk HPV genomes are frequently integrated into the host genome. Integration of HPV can also be found in high-grade lesions (e.g., grade 2/3 CIN). IARC monograph, p. 441.

The HPV L1 Open Reading Frame (ORF) is used to distinguish among, and identify new, HPV types, as it is the most conserved region in the HPV genome. A new type is recognized if the complete genome has been cloned and the DNA sequence of the L1 ORF differs by more than 10% from the closest known type. Differences in homology of between 2% and 10% define a subtype and those of less than 2% define a variant. (IARC Monograph Vol. 90, page 52).

Currently there is no effective treatment for persistent cervical HPV infection, LSIL or CIN1. Health care providers may choose to 'wait and watch' HPV infections, causing stress and anxiety in the patient due to the risk of progression to cervical cancer. Accordingly, there is a need for therapeutic treatments directed at persistent cervical HPV infection, or low-grade HPV lesions, particularly when caused by known high risk HPV types.

HPV Antigenic Proteins

HPV genomes are circular, and most encode six 'early' proteins and two 'late' proteins. The "early" proteins have regulatory functions, affecting HPV genome replication and transcription, as well as immune modulation and structural modification of infected cells. The E1 protein is required for initiation of viral DNA replication, and is needed for replication and amplification of the viral episome in the nucleus of the infected cell.

The HPV E1 protein includes an N-terminal regulatory region required for optimal replication in vivo but not in vitro, a DNA Binding Domain, and a C-terminal enzymatic domain (which comprises a minimal oligomerization domain sufficient for self-assembly into hexamers, ATPase activity region capable of unwinding DNA duplexes, and a brace region for assembly and stabilization of the E1 hexamer).

Regulatory HPV protein E2 plays an accessory role in initiation of DNA replication by activating or repressing transcription. The E2 protein contains a transactivation domain (TAD) important for transcriptional activation/repression and replication; a flexible linker, and a DNA binding dimerization domain (DBD) that affects transcriptional activation/repression and replication.

HPV protein E6 plays a role in the induction and maintenance of cellular transformation, and acts by stimulating the destruction of host cell regulatory proteins. E6 associates with host cell E6-AP ubiquitin-protein ligase (E6AP) and inactivates tumor suppressors such as TP53 by targeting them to the 26S proteasome for degradation. A PDZ ligand on the C-terminal of the E6 protein interacts with cellular PDZ-containing proteins, which can alter differentiation of cells.

Anti-HPV Vaccines

Prophylactic vaccines are designed to prevent infection, and prophylactic HPV vaccines have been developed (see, e.g., FUTURE II Study Group, 2007; Garland et al., 2007). GARDISIL™ 9 (Merck & Co) contains antigenic "late" proteins from nine HPV types (6, 11, 16, 18, 31, 33, 45, 52 and 58). CERVARIX™ (GlaxoSmithKline), contains antigenic "late" proteins from HPV 16 and 18. Both GARDISIL and CERVARIX provide virus-like particles (VLPs) of the HPV major capsid L1 protein. As stated in the current GARDISIL™ prescribing information for the United States, the efficacy of the vaccine is believe to be mediated by humoral responses induced by vaccination. Animal studies further support that the efficacy of HPV L1 VLP vaccines is largely mediated by the development of a humoral immune response.

A cross-protective effect of prophylactic HPV vaccines has been reported. Wheeler et al. (2012) evaluated the cross-protective efficacy of CERVARIX™ (HPV-16/18 AS04-adjuvanted vaccine) against HPV types other than HPV16 and HPV18. See also Malagon et al. (2012).

A therapeutic HPV vaccine is one designed for the treatment of HPV infection or related disease, and thus acts to eradicate infected cells, significantly reduce the number of infected cells, decrease the duration of infection, or slow or prevent the progression of low-grade lesions (e.g., CIN1 or LSIL). Once HPV infection has been established, it is considered unlikely that antibodies play a role in eradicating infected cells. Cytotoxic T lymphocytes (CTL) are believed to be the primary effectors of eradication (see, e.g., IARC monograph volume 90, p. 174).

VLPs can also induce T-cell responses. Vaccination of subjects with HPV 16 VLPs was shown to induce both CD4+ and CD8+ T-cell responses (Pinto et al., 2003; Oh, Y. K. et al., 2004). Herrin et al. report that both CERVARIX™ (HPV16/18) and GARDISIL™ (HPV6/11/16/18) are associated with CD4 T cell responses (Einstein et al., (2011); Herrin et al., (2014)). Chimeric VLPs that contain a linked segment of HPV E7 have been shown to induce specific HLA T cells in humans after in-vitro vaccination (Kaufmann et al., 2001).

Various live vector-based, peptide/protein-based, nucleic acid-based and whole cell-based therapeutic HPV vaccines targeting HPV E6 and E7 oncoproteins have been assessed (for review, see Lin et al., 2010; Hung et al., 2008).

Viral Vectors

Recombinant vaccinia viruses, which are able to carry large inserts and do not persist in the host, have been studied for use as vaccine vectors. However, individuals may have preexisting immunity to vaccinia virus which reduces the response to the administered vector. A recombinant vaccinia virus expressing the E6 and E7 genes of HPV 16 and 18 was created (Kaufmann et al., 2002). After a single vaccination, four patients developed cytotoxic T cells and eight developed serological responses to the HPV proteins. A recombinant vaccinia virus encoding modified E6 and E7 from HPV 16 and 18 has been tested in patients with vulvar intraepithelial neoplasia (VIN) (Baldwin et al., 2003; Davidson et al., 2003). Davidson et al. (2003) vaccinated 18 women with HPV 16-positive high-grade VIN with a single dose, which resulted in a reduction in the size of the lesion by at least 50% in eight patients. A second vaccination formulation, HPV 16 L2E6E7 fusion protein, has been tested in 10 patients with high-grade VIN. All but one demonstrated HPV 16-specific proliferative T-cell and/or serological responses following vaccination. However, no direct correlation between immunological and clinical responses was seen (Davidson et al., 2004).

Clinical trials of other viral delivery systems, including recombinant adenoviruses (Tobery et al., 2003), adeno-associated virus (Liu et al., 2000), RNA-based poliovirus (van Kuppeveld et al., 2002) and alphavirus (Velders et al., 2001) vaccines, constructed to express E7 or poly-epitope proteins, have been proposed or initiated.

Recombinant Vectors

In a first aspect, the present invention provides one or more recombinant vector(s) comprising nucleic acid sequences encoding:

antigenic Human Papillomavirus (HPV) polypeptides from a first HPV early protein, where said antigenic HPV polypeptides are from at least two different high-risk HPV types, and share at least 70% amino acid sequence identity with at least one additional high-risk HPV type, and antigenic HPV polypeptides from a second HPV early protein, where said antigenic HPV polypeptides are from at least two different high-risk HPV types, and share at least 70% amino acid sequence identity with at least one additional high-risk HPV type, and wherein each of said antigenic HPV polypeptides includes at least one T cell epitope, and said nucleic acid sequences are operatively linked to one or more sequences which direct expression of said antigenic HPV polypeptides in a mammalian host cell.

In one embodiment, the nucleic acid sequences express separate antigenic HPV polypeptides. In a preferred embodiment, the nucleic acid sequences express antigenic HPV polypeptides that are linked by a peptide linker.

In a preferred embodiment, the recombinant vector(s) do not comprise any nucleic acid sequence encoding an antigenic polypeptide from an HPV Late 1 (L1) protein or an HPV Late 2 (L2) protein.

In one embodiment, the nucleic acid sequences expressing antigenic HPV polypeptides from the first and second HPV early protein are located on the same recombinant vector. In an alternative embodiment, the nucleic acid sequences expressing antigenic HPV polypeptides from the first and second HPV early protein are located on two or more recombinant vectors.

Preferably, the recombinant vector(s) according to the invention comprise antigenic polypeptide sequences selected from HPV types HPV16, HPV18, HPV31, HPV33, HPV35, HPV39, HPV45, HPV51, HPV52, HPV56, HPV58, HPV59, HPV68, HPV73 and HPV82.

In one embodiment, the first HPV early protein is Early 1 (E1), and said second HPV early protein is selected from Early 2 (E2), Early 6 (E6), and Early 7 (E7). In another embodiment, the first HPV early protein is E2, and said second HPV early protein is selected from E1, E6 and E7. In another embodiment, the first HPV early protein is E6, and said second HPV early protein is selected from E1, E2 and E7. In another embodiment, the first HPV early protein is E7, and said second HPV early protein is selected from E1, E2 and E6.

The inventors found that in several mice models, nucleic acid constructs according to the invention comprising HPV-E1 antigenic polypeptides, in particular from HPV16 and HPV18, induced a strong and consistent HPV-E1 specific response, as well as strong cross reactive CD8+ T cell responses towards all high risk HPV types tested. This is a surprising finding because HPV-E1 has not been used as an immunogen in other approaches tested for the development of therapeutic HPV vaccines.

Preferably, the first HPV early protein is Early 1 (E1). Preferably still, the antigenic HPV polypeptides from E1 include antigenic polypeptides from HPV16 E1 and HPV18 E1. More preferably, the antigenic HPV polypeptides from E1 do not include antigenic polypeptides from other HPV types.

Suitably, the recombinant vector(s) encode:
E1 antigenic polypeptides having an amino acid sequence corresponding to amino acids 203-622 of HPV 16 E1 (SEQ ID NO:39), and optionally comprising a Glycine to Aspartic acid substitution at position 482 (G482D), and/or
E1 antigenic polypeptides having an amino acid sequence corresponding to amino acids 203-622 of HPV 18 E1, and optionally comprising a Glycine to Aspartic acid substitution at position 482 (G482D).

In a preferred embodiment, the recombinant vector(s) according to the invention further comprising a nucleic acid sequence encoding antigenic HPV polypeptides from a third HPV early protein, where said antigenic HPV polypeptides are from at least two different high-risk HPV types, and share at least 70% amino acid sequence identity, and each antigenic HPV polypeptide includes at least one T cell epitope. Suitably, the first HPV early protein is E1, the second HPV early protein is E2 and the third HPV early protein is E6. Preferably, the nucleic acid sequences encode antigenic polypeptides from HPV16 E1, HPV18 E1, HPV16 E2, HPV18 E2, HPV16 E6 and HPV18 E6.

Suitably, the recombinant vector(s) according to the invention further comprise a nucleic acid sequence encoding antigenic HPV polypeptides from a fourth HPV early protein, where said antigenic HPV polypeptides are from at least two different high-risk HPV types, and share at least 70% amino acid sequence identity, and each antigenic HPV polypeptide sequence includes at least one T cell epitope. Preferably, the first HPV early protein is E1, the second HPV early protein is E2, the third HPV early protein is E6 and the fourth HPV early protein is E7. Preferably, the nucleic acid sequences encode antigenic polypeptides from HPV16 E1, HPV18 E1, HPV16 E2, HPV18 E2, HPV16 E6, HPV18 E6, HPV16 E7 and HPV18 E7. In one embodiment, the nucleic acid sequences also encode antigenic polypeptides from HPV31 E2, HPV33 E2, HPV45 E2, HPV52 E2, HPV58 E2, HPV31 E6, HPV33 E6, HPV45 E6, HPV52 E6, HPV52 E6 and HPV58 E6.

According to one embodiment of the recombinant vector(s) according to the invention, the nucleic acid sequences encode one or more polypeptides that are at least 90%, 92%, 95%, 97%, 98%, 99% or 100% identical to a sequence selected from the group of SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:89, SEQ ID NO:90, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112 and SEQ ID NO:113.

According to one embodiment of the recombinant vector(s) according to the invention, the nucleic acid sequence encodes a polypeptide that is at least 90%, 92%, 95%, 97%, 98%, 99% or 100% identical to a sequence selected from the group consisting of SEQ ID NO:63, SEQ ID NO:64, SEQ ID NO:65, SEQ ID NO:66, SEQ ID NO:67, SEQ ID NO:85, SEQ ID NO:86, SEQ ID NO:87, SEQ ID NO:88, SEQ ID NO:91, SEQ ID NO:92, SEQ ID NO:93, SEQ ID NO:94, SEQ ID NO:132-SEQ ID NO:133, SEQ ID NO:134, SEQ ID NO:135, SEQ ID NO:136, SEQ ID NO:143, SEQ ID NO:145 and SEQ ID NO:147.

According to one embodiment of the recombinant vector(s) according to the invention, the nucleic acid sequence comprises a sequence which is at least 90%, 92%, 95%, 97%, 98%, 99% or 100% identical to a sequence selected from the group consisting of SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:137, SEQ ID NO:138, SEQ ID NO:139, SEQ ID NO:140, SEQ ID NO:141, SEQ ID NO:144, SEQ ID NO:146 and SEQ ID NO:148.

In one embodiment, the recombinant vector(s) are selected from:
a vector comprising a nucleic acid sequence encoding a polypeptide corresponding to SEQ ID NO:63,
a first vector comprising a nucleic acid sequence encoding a polypeptide selected from SEQ ID NO:64 and SEQ ID NO:66, and a second vector comprising a nucleic acid sequence encoding a polypeptide selected from SEQ ID NO:65 and SEQ ID NO:67,
a first vector comprising a nucleic acid sequence encoding a polypeptide selected from SEQ ID NO:85, SEQ ID NO:86 and SEQ ID NO 132, and a second vector comprising a nucleic acid sequence encoding a polypeptide selected from SEQ ID NO:87, SEQ ID NO:88 and SEQ ID NO:133,
a first vector comprising a nucleic acid sequence encoding a polypeptide selected from SEQ ID NO:91 and SEQ ID NO:92, and a second vector comprising a nucleic acid sequence encoding a polypeptide selected from SEQ ID NO:93 and SEQ ID NO:94,
a first vector comprising a nucleic acid sequence encoding a polypeptide corresponding to SEQ ID NO:134 and a second vector comprising a nucleic acid sequence encoding a polypeptide selected from SEQ ID NO:135 and SEQ ID NO:136.

In one embodiment of the recombinant vector(s) according to the invention, the first or second HPV early protein is E2, and the antigenic polypeptides each comprise or consist of a segment corresponding to amino acids 1-201 of HPV16E2 (SEQ ID NO:40) linked directly or via a peptide linker to a segment corresponding to amino acids 285-365 of HPV16E2 (SEQ ID NO:40), where said peptide linker is ten or fewer amino acids, such as 9, 8, 7, 6 5, 4, 3, 2 or 1 amino acid(s). Suitably, one or both of said antigenic polypeptides comprise a Lysine to Alanine substitution at amino acid position 111 (K111A).

In one embodiment of the recombinant vector(s) according to the invention, the first or second HPV early protein is E6, and the antigenic polypeptides are selected from a segment corresponding to amino acids 1-201 of HPV16E6 (SEQ ID NO:41), and a segment corresponding to amino acids 11-150 of HPV16E6 (SEQ ID NO:41). Suitably, one or both of said antigenic polypeptides comprise one or both of a Cysteine to Arginine substitution at amino acid position 110 (C110R), and a Phenylalanine to Arginine substitution at amino acid position 54 (F54R).

In one embodiment, the recombinant vector(s) encode E7 antigenic polypeptides having an amino acid sequence corresponding to amino acids 49-98 of SEQ ID NO:42 joined directly to amino acids 7-28 of SEQ ID NO:42, and optionally comprise a Cysteine to Glycine substitution at amino acid position 24 (C24G) and/or a Glutamic acid to Glutamine substitution at amino acid position 26 (E26Q).

In one embodiment of the recombinant vector(s) according to the invention, the nucleic acid sequence does not encode any antigenic polypeptide having at least 70% identity to an HPV Early protein from a non-high risk HPV type.

Adenoviral Vectors

In a preferred embodiment, the recombinant vector(s) according to the invention are adenovirus vectors capable of infecting mammalian, such as human, epithelial cells. Non-human primate adenovirus vectors, such as simian adenovirus vectors or chimpanzee adenovirus (ChAd) vectors, such as a ChAd 155 adenovirus vector, are preferred. Suitably, the adenoviral vector(s) comprise a modified backbone construct of ChAd155 selected from ChAd155 #1434 (SEQ ID NO: 7), ChAd155 #1390 (SEQ ID NO: 8) and ChAd155 #1375 (SEQ ID NO: 9). Suitably, the adenoviral vector(s) is a Group C simian adenovirus having a fiber sequence comprising amino acids corresponding to amino acids 321-356 of SEQ ID NO:1.

In one embodiment, the adenovirus vector is a replication-competent adenovirus. In an alternative embodiment, the adenovirus vector is a replication-incompetent adenovirus.

Suitably, the adenovirus vector can comprise a polynucleotide selected from the group consisting of:
  (a) a polynucleotide which encodes a polypeptide having the amino acid sequence according to SEQ ID NO: 1,
  (b) a polynucleotide which encodes a functional derivative of a polypeptide having the amino acid sequence according to SEQ ID NO: 1, wherein the functional derivative has an amino acid sequence which is at least 80% identical over its entire length to the amino acid sequence of SEQ ID NO: 1, and
  (c) a polynucleotide which encodes a polypeptide having the amino acid sequence according to SEQ ID NO: 3.

Suitably, the adenovirus vector comprises a mutation or deletion which renders non-functional at least one gene of an adenovirus genomic region selected from the group consisting of E1A, E1B, E2A, E2B, E3 and E4.

RNA Vectors

In one embodiment, the recombinant vector(s) according to the invention are RNA vectors. Suitably, the sequence of the RNA vector(s) is codon optimized. In a preferred embodiment, the RNA vector comprises or consists of a self-replicating RNA (or "SAM") molecules. 22. The recombinant vector(s) according to any one of claims 1 to 19, which are RNA vectors, preferably the RNA vectors comprise or consist of self-replicating RNA (or "SAM") molecules.

In one embodiment, the RNA vector(s) comprise:
  a first SAM vector may express antigenic peptides from E1 of hrHPV types 16 and 18 and antigenic peptides from E6 proteins of hrHPV types 16, 18, 31, 33, 45, 52 and 58;
  a second SAM vector may express antigenic peptides from E2 of hrHPV types 16, 18, 31 and 33; and
  a third SAM vector may express antigenic peptides from E7 of hrHPV types 16 and 18 and antigenic peptides from E2 proteins of hrHPV types 45, 52 and 58.

In one embodiment, RNA vector(s) are part of an immunogenic composition which further comprises a non-viral delivery material, such as a submicron cationic oil-in-water emulsion; a liposome; or a biodegradable polymeric microparticle delivery system.

The invention provides a method of manufacturing an immunogenic composition comprising the steps of combining (i) one or more RNA construct(s) or self-replicating RNA molecule(s) according to the invention with (ii) a non-viral delivery material, such as a submicron cationic oil-in-water emulsion; a liposome; or a biodegradable polymeric microparticle delivery system; wherein the one or more RNA construct(s) or self-replicating RNA molecule(s) according to the invention (A) in physical contact with said non-viral delivery material or (B) packaged in a first container and said non-viral delivery material packaged in a second container.

Immunogenic Compostions

In one aspect, the invention provides an immunogenic composition comprising one or more recombinant vector(s) according to the invention a pharmaceutically acceptable carrier. In one embodiment, the immunogenic composition comprising two or more recombinant vector(s).

In one embodiment, the immunogenic composition further comprises an adjuvant. Suitable adjuvants for use in the present invention include metal salts, saponins, cytokines, monophosphoryl lipid A, 3-de-O-acylated monophosphoryl lipid A (3D-MPL), Toll-like receptor (TLR) agonists, and immunostimulatory oligonucleotides containing unmethylated CpG dinucleotides.

In one embodiment, the immunogenic composition further comprises at least one isolated antigenic HPV polypeptide from HPV E1, E2, E6 or E7, from a high-risk HPV type.

In one embodiment, the immunogenic composition does not comprise any antigenic polypeptides from Late (L) HPV proteins.

Use in Therapy and Methods of Treatment

In another aspect, there is provided the recombinant vector(s) or immunogenic composition according to the invention, for use as a medicament.

In another aspect, there is provided the recombinant vector(s) or immunogenic composition according to the invention for use in the treatment of an HPV-related condition of the human anogenital tract, selected from infection by HPV such as a high-risk HPV type, and, lesions of the cervical epithelium, such as Cervical Intraepithelial Neoplasia grade 1 (CIN1) and low-grade squamous intraepithelial lesions (LSIL).

In another aspect, there is provided a first and a second recombinant vector according to the invention, where said first and second recombinant vector encode at least one antigenic polypeptide from (a) different HPV early proteins, or (b) different HPV types, for use in a method of inducing an immune response in a mammalian subject, wherein the first and second recombinant vectors are co-administered.

Suitably, the first and second recombinant vector together encode
  antigenic polypeptides from the E2 protein and E6 protein from each of HPV16, 18, 31, 33, 45, 52 and 58, and
  an antigenic polypeptide from the E1 protein and the E7 protein from each of HPV16 and 18.

In a preferred embodiment, the method of inducing an immune response is a method of treatment of HPV-related disease of the human anogenital tract selected from infection by HPV such as a high-risk HPV type, and, lesions of the cervical epithelium, such as Cervical Intraepithelial Neoplasia grade 1 (CIN1) and low-grade squamous intraepithelial lesions (LSIL).

Suitably, the method comprises subsequent administration of a further recombinant vector according to the invention.

Suitably, the method further comprises co-administration with the first and second recombinant vector of an isolated antigenic polypeptides from at least one HPV early protein from a high-risk HPV type, optionally with an adjuvant.

Suitably, the method further comprises subsequent administration of an isolated antigenic polypeptides from at least one HPV early protein from a high-risk HPV type, and an adjuvant.

In another aspect, there is provided the use of one or more recombinant vector(s) or immunogenic composition according to the invention in the manufacture of a medicament for treating an HPV-related condition of the human anogenital tract, selected from infection by a high-risk HPV type, CIN, and LSIL.

In another aspect, there is provided a method of inducing an immune response in a mammalian subject comprising administering to the subject one or more recombinant vector(s) or immunogenic composition according to the invention.

In another aspect, there is provided a method of inducing an immune response in a mammalian subject comprising co-administration to the subject of a first and a second recombinant vector according to the invention, where said first and second recombinant vector encode at least one antigenic polypeptide from (a) different HPV early proteins, or (b) different HPV types.

Suitably, the first and second recombinant vectors encode antigenic polypeptides from the E2 protein and E6 protein from each of HPV16, 18, 31, 33, 45, 52 and 58, and antigenic polypeptide from the E1 protein and the E7 protein from each of HPV16 and 18.

In a preferred embodiment, the method according to the invention is for the treatment of HPV-related disease of the human anogenital tract.

Suitably, the method according to the invention further comprises subsequent administration of a recombinant adenovirus according to the invention.

Suitably, the method further comprises co-administration of isolated antigenic polypeptides from at least one HPV early protein from a high-risk HPV type, optionally with an adjuvant.

Suitably, the method further comprises subsequent administration of an isolated antigenic polypeptides from at least one HPV early protein from a high-risk HPV type, and an adjuvant.

In another aspect, there is provided a method of treating infection of the human anogenital epithelium by a high-risk HPV type, comprising co-administering to a subject in need of treatment, vectors expressing:

(a) an antigenic polypeptide from each of E1, E2 and E6 from HPV16,
(b) an antigenic polypeptide from each of E1, E2, and E6 from HPV18, and
(c) an antigenic polypeptide sequence from the E2 or E6 protein from no more than six additional HPV types, said additional HPV types selected from the group consisting of HPV31, 33, 45, 52, 58, 56, 51, 39, 35, 59, 68, 73, and 82;

where said antigenic polypeptides include at least one sequence having at least 70% sequence identity to an Early protein from each of HPV31, 33, 45, 52, 58, 56, 51, 39, 35, 59, 68, 73, and 82; and wherein administration induces specific cell-mediated immunity against HPV16 and HPV18, and cross-reactive cell-mediated immunity against at least one of the additional HPV types that was not selected in step (c).

Preferably, the method comprises administering antigenic polypeptides from both the E2 and E6 protein from said no more than six additional HPV types. Suitably, the method comprises administering antigenic polypeptides from both the E2 and E6 proteins of HPV31, 33, 45, 52 and 58, wherein administration induces cross-reactive cell-mediated immunity against HPV35. Suitably, the antigenic polypeptides are co-administered using one or more recombinant adenoviral vectors, such as non-human adenoviral vectors, such as a ChAd155 vector. In one embodiment, the infection of the human anogenital epithelium by a high-risk HPV type has resulted in lesions of the cervical epithelium, such as lesions identified as CIN1 or LSIL. In one embodiment, no antigenic polypeptides from HPV Late proteins are co-administered.

In one embodiment, the therapeutic method of the present invention comprises the administration of three SAM vectors, wherein:

a first SAM vector may express antigenic peptides from E1 of hrHPV types 16 and 18 and antigenic peptides from E6 proteins of hrHPV types 16, 18, 31, 33, 45, 52 and 58;

a second SAM vector may express antigenic peptides from E2 of hrHPV types 16, 18, 31 and 33; and a third SAM vector may express antigenic peptides from E7 of hrHPV types 16 and 18 and antigenic peptides from E2 proteins of hrHPV types 45, 52 and 58.

Polypeptides

In another aspect, there is provided a polypeptide comprising or consisting of one or more contiguous amino acid sequence that is at least 90%, 92%, 95%, 97%, 98%, 99% or 100% identical to a sequence selected from the group of SEQ ID NO:43, SEQ ID NO:44, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:89, SEQ ID NO:90, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112 and SEQ ID NO:113.

Preferably, the polypeptide comprises two or more contiguous amino acid sequence that is at least 90%, 92%, 95%, 97%, 98%, 99% or 100% identical to a sequence selected from the group of SEQ ID NO:43, SEQ ID NO:44, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:89, SEQ ID NO:90, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112 and SEQ ID NO:113.

In another aspect, there is provided a polynucleotide molecule comprising or consisting of a nucleic acid sequence encoding a polypeptide according to the invention. Suitably, the polynucleotide molecule comprises or consists of a nucleic acid sequence encoding at least two polypeptides according to the invention.

In another aspect, there is provided a polypeptide consisting of or comprising a first fragment of an HPV E7 protein and a second fragment of an HPV E7 protein, where said first fragment corresponds to amino acids 49-98 of SEQ ID NO:42 and said second fragment corresponds to amino acids 7-28 of SEQ ID NO:42, wherein the C-terminus of the first fragment is joined directly to the N-terminus of the second fragment, and where said polypeptide optionally comprising a Cysteine to Glycine substitution at amino acid position 24 (C24G) and/or a Glutamic acid to Glutamine substitution at amino acid position 26 (E26Q) of said second fragment.

In another aspect, there is provided a polypeptide comprising or consisting of a contiguous amino acid sequence that is at least 90%, 92%, 95%, 97%, 98%, 99% or 100% identical to a sequence selected from the group of SEQ ID NO:50, SEQ ID NO:63, SEQ ID NO:64, SEQ ID NO:65, SEQ ID NO:66, SEQ ID NO:67, SEQ ID NO:85, SEQ ID NO:86, SEQ ID NO:87, SEQ ID NO:88, SEQ ID NO:91, SEQ ID NO:92, SEQ ID NO:93-SEQ ID NO:94, SEQ ID NO:132, SEQ ID NO:133, SEQ ID NO:134, SEQ ID NO:135, SEQ ID NO:136, SEQ ID NO:143, SEQ ID NO:145 and SEQ ID NO:147.

In another aspect, there is provided a polynucleotide molecule comprising or consisting of a nucleic acid sequence encoding a polypeptide according to the invention.

Adenoviral Vaccine Vectors

Certain adenoviruses have been used for gene transfer applications due to an ability to achieve efficient gene transfer in a variety of target tissues, and a large transgene capacity. Conventionally, E1 genes of adenovirus are deleted and replaced with a transgene cassette consisting of the promoter of choice, cDNA sequence of the gene of interest and a poly A signal, resulting in a replication-defective recombinant virus.

Recombinant adenoviruses are useful in gene therapy and in vaccines. Viral vectors based on chimpanzee (chimp) adenovirus represent an alternative to the use of human-derived adenoviral vectors for the development of genetic vaccines. Adenoviruses isolated from chimpanzees are closely related to adenoviruses isolated from humans, as demonstrated by their efficient propagation in cells of human origin. However, serologic cross reactivity between chimp adenovirus(es) and a human adenovirus(es) is possible. In humans, preexisting humoral immunity can result in the production and persistence of antibodies that are specific for adenoviral proteins. The humoral response elicited by adenovirus is mainly directed against the three major adenoviral structural capsid proteins: fiber, penton and hexon.

Adenoviruses have a characteristic morphology with an icosahedral capsid comprising three major proteins, hexon (II), penton base (III) and a knobbed fiber (IV), along with a number of other minor proteins, VI, VIII, IX, IIIa and IVa2. The virus genome is a linear, double-stranded DNA. The virus DNA is intimately associated with the highly basic protein VII and a small peptide pX (formerly termed mu). Another protein, V, is packaged with this DNA-protein complex and provides a structural link to the capsid via protein VI. The virus also contains a virus-encoded protease, which is necessary for processing of some of the structural proteins to produce mature infectious virus.

The adenoviral genome is well characterized. There is general conservation in the overall organization of the adenoviral genome with respect to specific open reading frames being similarly positioned, e.g. the location of the E1A, E1B, E2A, E2B, E3, E4, L1, L2, L3, L4 and L5 genes of each virus. Each extremity of the adenoviral genome comprises a sequence known as an inverted terminal repeat (ITR), which is necessary for viral replication. The virus also comprises a virus-encoded protease, which is necessary for processing some of the structural proteins required to produce infectious virions. The structure of the adenoviral genome is described using the order in which the viral genes are expressed following host cell transduction; the viral genes are referred to as early (E) or late (L) genes according to whether transcription occurs prior to or after onset of DNA replication. In the early phase of transduction, the E1A, E1B, E2A, E2B, E3 and E4 genes of adenovirus are expressed to prepare the host cell for viral replication. During the late phase of infection, expression of the late genes L1-L5, which encode the structural components of the virus particles, is activated.

Adenoviruses are species-specific and different serotypes, i.e., types of viruses that are not cross-neutralized by antibodies, have been isolated from a variety of mammalian species. More than 50 serotypes have been isolated from humans, and are divided into six subgroups (Tatsis and Ertl, (2004)). Numerous adenoviruses have been isolated from nonhuman simians such as chimpanzees, bonobos, rhesus macaques and gorillas, and are classified into the same human groups based on phylogenetic relationships of hexon or fiber sequences (Colloca et al. (2012) ScienceTranslational Medicine 4:1-9; Roy et al. (2004) *Virology* 324: 361-372; Roy et al. (2010) *Journal of Gene Medicine* 13:17-25).

Adenovirus Capsid Proteins and Polynucleotides Encoding these Proteins

The adenoviral capsid comprises 240 trimeric hexon capsomeres and 12 penton bases. The hexon protein accounts for the majority of the structural components of the capsid. Certain areas of the hexon polypeptide are highly conserved among adenoviral serotypes, while other areas vary (see, e.g., Tatsis and Ertl (2004)). The adenoviral penton protein forms a pentameric base to which the fiber protein attaches. The trimeric fiber protein protrudes from viral capsid, and is a knobbed, rod-like structure. The primary role of the fiber protein is tethering the viral capsid to cell surfaces via interaction with a cellular receptor.

The fiber proteins of many adenovirus (Ad) serotypes share a common architecture: an N-terminal tail, a central shaft made of repeating sequences, and a C-terminal globular knob domain (or 'head'). The shaft connects the N-terminal tail with the globular knob structure, which interacts with the target cellular receptor. Amino acid sequence variations in the fiber proteins from different adenoviral serotypes influences both the function and structure of the protein. For example, a number of exposed regions on the surface of the fiber knob present an easily adaptable receptor binding site. The globular shape of the fiber knob allows receptors to bind at the sides or on top of the knob. These binding sites typically lie on surface-exposed loops that are poorly conserved among human adenoviruses. As a structurally complex virus ligand, the fiber protein allows the presentation of a variety of binding surfaces (knob) in a number of orientations and distances (shaft) from the viral capsid.

Adenoviral fiber plays an important role in receptor-binding and immunogenicity of adenoviral vectors. Pseudo-typing Ad 5 particles with an alternate fiber shaft and knob removes cell binding domains and may allow more efficient (and potentially more cell-selective) transgene delivery to defined cell types, compared to that achieved with non-pseudotyped Ad 5. Neutralization of fiber-pseudotyped Ad particles may also be reduced if the fibers used are from Ads with lower seroprevalence in humans or experimental models, a situation that favours successful administration of the vector (Nicklin et al (2005)). Furthermore, full length fiber as well as isolated fiber knob regions, but not hexon or penton alone, are capable of inducing dendritic cell maturation and are associated with induction of a potent CD8+ T cell response (Molinier-Frenkel et al. *J. Biol. Chem.* (2003) 278:37175-37182).

The alignment provided in FIGS. 1A-C illustrates the differences between the fiber proteins of Group C simian adenoviruses. The fiber sequences of these adenoviruses can be broadly grouped into those having a long fiber, such as Chimpanzee Adenovirus 155 (ChAd155), or a short fiber, such as ChAd3. This length differential is due to a 36 amino acid deletion (corresponding to deletion of amino acids 321-356 of ChAd155 fiber sequence, see FIG. 1B). It has been shown that one of the determinants of viral tropism is the length of the fiber shaft. It has been demonstrated that an Ad5 vector with a shorter shaft has a lower efficiency of binding to CAR receptor and a lower infectivity (Ambriović-Ristov et al. (2003)). It has been speculated that this is the result of an increased rigidity of the shorter fiber leading to a less efficient attachment to the cell receptor (Wu, E et al.: *J Virol.* (2003) 77(13): 7225-7235). These studies may explain the different properties of ChAd155, which has a longer and more flexible fiber in comparison with the previously described ChAd3 and Bonobo adenovirus 3 (PanAd3) (which carries a short fiber).

All three capsid proteins of ChAd155 are expected to contribute to low seroprevalence in humans and can, thus, be used independently from each other or in combination to reduce the affinity of an adenovirus to preexisting neutralizing antibodies in humans, e.g. the capsid proteins can be used to manufacture a recombinant adenovirus with a reduced seroprevalence. Such a recombinant adenovirus may be a chimeric adenovirus with capsid proteins from different serotypes with at least a fiber protein having a sequence from ChAd155.

The ChAd155 fiber polypeptide sequence is provided in SEQ ID NO: 1. The ChAd155 penton polypeptide sequence is provided in SEQ ID NO: 3. The ChAd155 hexon polypeptide sequence is provided in SEQ ID NO: 5.

Recombinant Adenoviruses Comprising Polypeptide Sequences of ChAd155 Fiber

A recombinant adenoviral vector may comprise a polypeptide having the ChAd155 amino acid sequence according to SEQ ID NO: 1. The recombinant adenovirus may comprise a polypeptide which is a functional derivative of a polypeptide having the amino acid sequence according to SEQ ID NO: 1, wherein the functional derivative has an amino acid sequence which is at least 80%, 85%, 90%, 91%, 93%, 95%, 97%, 98%, 99%, 99.2%, 99.4%, 99.5%, 99.6%, 99.75, 99.8%, or 99.9% identical over its entire length to the amino acid sequence of SEQ ID NO: 1. Alternatively the functional derivative has no more than 130, 120, 110, 100, 90, 80, 70, 60, 50, 40, 30, 20, 10, 5, 4, 3, 2 or 1 amino acid addition(s), deletion(s) or substitutions(s) compared to SEQ ID NO: 1.

Suitably the recombinant adenoviral vector further comprises: (a) a polypeptide having the amino acid sequence according to SEQ ID NO: 3; or (b) a functional derivative of a polypeptide having the amino acid sequence according to SEQ ID NO: 3, wherein the functional derivative has an amino acid sequence which is at least 50.0% identical over its entire length to the amino acid sequence of SEQ ID NO: 3, and/or (a) a polypeptide having the amino acid sequence according to SEQ ID NO: 5; or (b) a functional derivative of a polypeptide having the amino acid sequence according to SEQ ID NO: 5, wherein the functional derivative has an amino acid sequence which is at least 50% identical over its entire length to the amino acid sequence of SEQ ID NO: 5.

Suitably the functional derivative of a polypeptide having the amino acid sequence according to SEQ ID NO: 3 has an amino acid sequence which is at least 60.0%, 70.0%, 80.0%, 85.0%, 90.0%, 91.0%, 93.0%, 95.0%, 97.0%, 98.0%, 99.0%, 99.2%, 99.4%, 99.5%, 99.6%, 99.7%, 99.8%, or 99.9% identical over its entire length to the amino acid sequence of SEQ ID NO: 3. Alternatively the functional derivative has no more than 300, 250, 200, 150, 125, 100, 90, 80, 70, 60, 50, 40, 30, 20, 10, 5, 4, 3, 2, or 1 amino acid addition(s), deletion(s) or substitutions(s) compared to SEQ ID NO: 3.

Suitably the functional derivative of a polypeptide having the amino acid sequence according to SEQ ID NO: 5 has an amino acid sequence which is at least 60.0%, 70%, 80.0%, 85.0%, 90.0%, 91.0%, 93.0%, 95.0%, 97.0%, 98.0%, 99.0%, 99.2%, 99.4%, 99.5%, 99.6%, 99.7%, 99.8%, or 99.9% identical over its entire length to the amino acid sequence of SEQ ID NO: 5. Alternatively the functional derivative has no more than 500, 400, 300, 250, 200, 150, 125, 100, 90, 80, 70, 60, 50, 40, 30, 20, 10, 5, 4, 3, 2, or 1 amino acid addition(s), deletion(s) or substitutions(s) compared to SEQ ID NO: 5.

The vector or recombinant adenovirus may comprise a polynucleotide which encodes a polypeptide having the amino acid sequence according to SEQ ID NO: 1, e.g., a polynucleotide of SEQ ID NO: 2. The recombinant adenovirus may comprise a polynucleotide encoding a polypeptide which is a functional derivative of a polypeptide of SEQ ID NO: 1 as described above. The vector or recombinant adenovirus may further comprise a polynucleotide encoding a polypeptide having SEQ ID NO: 3, or a functional derivative thereof as described above. The vector or recombinant adenovirus may further comprise a polynucleotide encoding a polypeptide having SEQ ID NO: 5, or a functional derivative thereof as described above.

Recombinant Adenoviruses Comprising Polypeptide Sequences of ChAd155 Penton

Suitably the vector or recombinant adenovirus comprises a polypeptide having the amino acid sequence according to SEQ ID NO: 3.

Suitably the recombinant adenovirus further comprises: (a) a polypeptide having the amino acid sequence according to SEQ ID NO: 1; or (b) a functional derivative of a polypeptide having the amino acid sequence according to SEQ ID NO: 1, wherein the functional derivative has an amino acid sequence which is at least 80% identical over its entire length to the amino acid sequence of SEQ ID NO: 1 and/or (a) a polypeptide having the amino acid sequence according to SEQ ID NO: 5; or (b) a functional derivative of a polypeptide having the amino acid sequence according to SEQ ID NO: 5, wherein the functional derivative has an amino acid sequence which is at least 60% identical over its entire length to the amino acid sequence of SEQ ID NO: 5.

Suitably the functional derivative of a polypeptide having the amino acid sequence according to SEQ ID NO: 1 has an amino acid sequence which is at least 60%, 70%, 80%, 85%, 90%, 91%, 93%, 95%, 97%, 98%, 99%, 99.2%, 99.4%, 99.5%, 99.6%, 99.7%, 99.8%, or 99.9% identical over its entire length to the amino acid sequence of SEQ ID NO: 1. Alternatively the functional derivative has no more than 130, 120, 110, 100, 90, 80, 70, 60, 50, 40, 30, 20, 10, 5, 4, 3, 2 or 1 amino acid addition(s), deletion(s) or substitutions(s) compared to SEQ ID NO: 1.

Suitably the functional derivative of a polypeptide having the amino acid sequence according to SEQ ID NO: 5 has an amino acid sequence which is at least 60.0%, 70%, 80.0%, 85.0%, 90.0%, 95.0%, 97.0%, 99.0%, 99.2%, 99.4%, 99.5%, 99.6%, 99.7%, 99.8%, or 99.9% identical over its entire length to the amino acid sequence of SEQ ID NO:5. Alternatively the functional derivative has no more than 500, 450, 350, 300, 250, 200, 150, 125, 100, 90, 80, 70, 60, 50, 40, 30, 20, 10, 5, 4, 3, 2, or 1 amino acid addition(s), deletion(s) or substitutions(s) compared to SEQ ID NO: 5.

The vector or recombinant adenovirus may comprise a polynucleotide which encodes a polypeptide having the amino acid sequence according to SEQ ID NO: 3. The recombinant adenovirus may comprise a polynucleotide encoding a polypeptide having SEQ ID NO:1 (such as SEQ ID NO:2), or a functional derivative of a polypeptide of SEQ ID NO: 1 as described above. The vector or recombinant adenovirus may further comprise a polynucleotide encoding a polypeptide having SEQ ID NO: 5, or a functional derivative thereof as described above.

ChAd155 Backbones

In one embodiment, the chimp adenovirus ChAd155 is utilized as a viral vector to carry the nucleotide constructs of the invention. The unmodified, wild type, sequence of ChAd155 is provided at SEQ ID NO: 10. Modified backbone constructs of ChAd155 include ChAd155 #1434 (SEQ ID NO: 7), ChAd155 #1390 (SEQ ID NO: 8) and ChAd155 #1375 (SEQ ID NO: 9). ChAd155 backbones may be used in the construction of recombinant replication-competent or replication-incompetent adenoviruses for example for the delivery of transgenes, particularly transgenes encoding HPV antigenic peptides as described herein.

Annotation of the ChAd155 wild type sequence (SEQ ID NO: 10) sequence is provided below.

```
LOCUS            ChAd155          Two putative ORFs in the
37830 bp    DNA       linear    10-  E3 region added manually
JUN-2015
DEFINITION  Chimp adenovirus 155,  FEATURES    Location/Qualifiers
complete genome.
COMMENT     Annotation according to
alignment of ChAd155 against the human
            Adenovirus   2   reference
strain NC_001405
source    1..37830                    /mol_type="genomic DNA"
     /organism="Chimpanzee adenovirus       /acronym="ChAd155"
155"                                  repeat_region   1..101
     /standard_name="ITR"             prim_transcript
     /rpt_type=inverted               complement(4117..27494)
gene    466..1622                          /gene="E2B"
     /gene="E1A"                      gene   complement(4117..5896)
TATA_signal   466..471                     /gene="IVa2"
     /gene="E1A"                      prim_transcript complement(4117..5896)
prim_transcript 497..1622                  /gene="IVa2"
     /gene="E1A"                      CDS
CDS   join(577..1117,1231..1532)      complement(join(4151..5487,5766..5778)
     /gene="E1A"                      )
     /product="E1A_280R"                    /gene="IVa2"
CDS   join(577..979,1231..1532)             /product="E2B_IVa2"
     /gene="E1A"                      polyA_signal   complement(4150..4155)
     /product="E1A_243R"                    /note="IVa2, E2B"
polyA_signal   1600..1605             CDS
     /gene="E1A"                      complement(join(5257..8838,14209..14217))
gene    1662..4131
     /gene="E1B"                            /gene="E2B"
TATA_signal   1662..1667                    /product="E2B_polymerase"
     /gene="E1B"                      gene    6078..34605
prim_transcript 1692..4131                  /gene="L5"
     /gene="E1B"                      gene    6078..28612
CDS      1704..2267                         /gene="L4"
     /gene="E1B"                      gene    6078..22658
     /product="E1B_19K"                     /gene="L3"
CDS    2009..3532                     gene    6078..18164
     /gene="E1B"                            /gene="L2"
     /product="E1B_55K"               gene    6078..14216
gene    3571..4131                          /gene="L1"
     /gene="IX"                       TATA_signal   6078..6083
TATA_signal   3571..3576                    /note="L"
     /gene="IX"                       prim_transcript 6109..34605
prim_transcript 3601..4131                  /gene="L5"
     /gene="IX"                       prim_transcript 6109..28612
CDS   3628..4092                            /gene="L4"
     /gene="IX"                       prim_transcript 6109..22658
     /product="IX"                          /gene="L3"
polyA_signal 4097..4102                prim_transcript 6109..18164
     /note="E1B, IX"                        /gene="L2"
gene   complement(4117..27523)        prim_transcript 6109..14216
     /gene="E2B"                            /gene="L1"
```

```
CDS   join(8038..8457,9722..9742)
      /gene="L1"
      /product="L1_13.6K"
CDS
complement(join(8637..10640,14209..142
17))
      /gene="E2B"
      /product="E2B_pTP"
gene    10671..10832
      /gene="VAI"
misc_RNA   10671..10832
      /gene="VAI"
      /product="VAI"
gene    10902..11072 55
      /gene="VAII"
misc_RNA 10902.11072
      /gene="VAII"
      /product="VAII"
CDS 11093..12352
      /gene="L1"
      /product="L1_52K"
CDS 2376..14157
      /gene="L1"
      /product="L1_pIIIa"
polyA_signal 14197..14202
      /gene="L1"
CDS 14254..16035
      /gene="L2"
      /product="L2_penton"
CDS 16050..16646
      /gene="L2"
      /product="L2_pVII"
CDS 16719..17834
      /gene="L2"
      /product="L2_V"
CDS 17859..18104
      /gene="L2"
      /product="L2_pX"
polyA_signal 18143..18148
      /gene="L2"
CDS 18196..18951
TATA_signal
complement(27518..27523)
      /note="E2A, E2B; nominal"
CDS   27604..28287
      /gene="L4"
      /product="L4_pVIII"
gene   27969..32686
      /gene="E3B"
gene   27969..31611
      /gene="E3A"
TATA_signal   27969..27974
      /note="E3A, E3B"
prim_transcript 27998..32686
      /gene="E3B"
prim_transcript 27998..31611
      /gene="E3A"
CDS    28288..28605
      /gene="E3A"
      /product="E3 ORF1"
polyA_signal   28594..28599
      /gene="L4"
CDS   29103..29303
      /gene="E3A"
      /product="E3 ORF2"
CDS    29300..29797
      /gene="E3A"
      /product="E3 ORF3"
CDS    29826..30731
      /gene="E3A"
      /product="E3 ORF4"
CDS   30728..31579
      /gene="E3A"
      /product="E3 ORF5"
CDS   31283..31579
      /gene="E3A"
      /product="E3 ORF6"
      /gene="L3"
      /product»"L3_ pVI"
CDS   19063..21945
      /gene="L3"
      /product="L3_hexon"
CDS    21975..22604
      /gene="L3"
      /product="L3_protease"
polyA_signal   22630..22635
      /gene="L3"
gene   complement(22632..27523)
      /gene="E2A"
prim_transcript
complement(22632..27494)
      /gene="E2A"
gene   complement(22632..26357)
      /gene="E2A-L"
prim_transcript
complement(22632..26328)
      /gene="E2A-L"
polyA_signal   complement(22649..22654)
      /note="E2A, E2A-L"
CDS   complement(22715..24367)
      /gene="E2A"
      /note="DBP; genus-common; DBP
family"
      /codon_start=1
      /product="E2A"
CDS    24405..26915
      /gene="L4"
      /product="L4_100k"
TATA_signal
complement(26352..26357)
      /gene="E2A-L"
CDS   join(26602..26941,27147..27529)
      /gene="L4"
      /product="L4_33K"
CDS    26602..27207
      /gene="L4"
      /product="L4_22K"

/product="E3 ORF7"
CDS    31866..32264
      /gene="E3B"
      /product="E3 ORF8"
CDS    32257..32643
      /gene="E3B"
      /product="E3 ORF9"
polyA_signal   32659..32664
      /gene="E3B"
gene complement(<32678..32838)
      /gene="U"
CDS   complement(<32678.. 32838)
      /gene;="U"
      /note="exon encoding C terminus
unidentified;
genus-common"
      /product="protein U"
CDS   3849..34585
      /gene="L5"
      /product="L5_fiber"
polyA_signal   34581..34586
      /gene="L5"
gene    complement(34611..37520)
      /gene="E4"
prim_transcript
complement(34611..37490)
      /gene="E4"
polyA_signal complement(34625..34630)
      /gene="E4"
CDS
complement(join(34794..35069,35781..35
954))
      /gene="E4"
      /product="E4 ORF7"
CDS   complement(35070..35954)
      /gene="E4"
      /product="E4 ORF6"
```

| | |
|---|---|
| polyA_signal 31578..31584<br>/gene="E3A"<br>CDS 31591..31863<br>/gene="E3B"<br>/gene="E4"<br>/product="E4 ORF3"<br>CDS complement(36579..36971)<br>/gene="E4"<br>/product="E4 ORF2"<br>CDS complement(37029..37415)<br>/gene="E4" | CDS complement(35875..36219)<br>/gene="E4"<br>/product="E4 ORF4"<br>CDS complement(36235..36582)<br>/product="E4 ORF1"<br>TATA_signal complement(37515..37520)<br>/gene="E4"<br>repeat_region 37740..37830<br>/standard_name="ITR"<br>/rpt_type=inverted |

Further ChAd155 Adenoviral Vectors

In some embodiments, the polynucleotide of the adenoviral vector used in the present invention comprises a polynucleotide encoding a ChAd155 hexon polypeptide, a penton polypeptide and a fiber polypeptide; and may further comprise additional adenoviral polynucleotides, suitably ChAd155 polynucleotides. Thus, suitably the polynucleotide comprises the following (sequence coordinates are relative to SEQ ID NO:10 provided in the previous annotation):

(a) an adenoviral 5'-inverted terminal repeat (ITR);
(b) an adenoviral E1A region, or a fragment thereof selected from among the E1A_280R and E1A_243R regions;
(c) an adenoviral E1B or IX region, or a fragment thereof selected from among the group consisting of the E1B_19K, E1B_55K and IX regions;
(d) an adenoviral E2B region; or a fragment thereof selected from among the group consisting of the E2B_pTP, E2B_polymerase and E2B IVa2 regions;
(e) an adenoviral L1 region, or a fragment thereof, said fragment encoding an adenoviral protein selected from the group consisting of the L1_13.6K, L1_52K and L1_pIIIa protein;
(f) an adenoviral L2 region or a L2 region comprising a polynucleotide encoding the ChAd155 penton protein, or a fragment thereof, said fragment encoding an adenoviral protein selected from the group consisting of the L2_penton protein, the L2pVII protein, the L2_V protein and the L2_pX protein;
(g) an adenoviral L3 region or a L3 region comprising a polynucleotide encoding the hexon protein of ChAd155, or a fragment thereof, said fragment encoding an adenoviral protein selected from the group consisting of the L3_pVI protein, the L3 hexon protein and the L3 protease protein;
(h) an adenoviral E2A region;
(i) an adenoviral L4 region, or a fragment thereof said fragment encoding an adenoviral protein selected from the group consisting of the L4_100k protein, the L4_33K protein, the L4_22K protein and protein L4_VIII;
(j) an adenoviral E3 region, or a fragment thereof selected from the group consisting of E3 ORF1, E3 ORF2, E3 ORF3, E3 ORF4, E3 ORF5, E3 ORF6, E3 ORF7, E3 ORF8, and E3 ORF9;
(k) an adenoviral L5 region or a L5 region comprising a polynucleotide encoding the L5_fiber fiber polypeptide of ChAd155;
(l) an adenoviral (such as Ad5) E4 region, or a fragment thereof selected from the group consisting of E4 ORF7, E4 ORF6, E4 ORF4, E4 ORF3, E4 ORF2, and E4 ORF1; in particular ORF6 of said E4 region;
(m) an adenoviral 3'-ITR; and/or
(n) an adenoviral VAI or VAII RNA region, preferably an adenoviral VAI or VAII RNA region from an adenovirus other than ChAd155, more preferably from human Ad5.

Use of the adenoviral vectors as described herein with transgenes encoding antigenic HPV polypeptides may have one or more following improved characteristics over other adenoviral vectors, including but not limited to higher productivity, improved immunogenicity and increased transgene expression. The ChAd155 vectors are useful in the expression of one or more HPV antigenic polypeptides, and are useful as vaccine vectors for the delivery of HPV protein(s), polypeptide(s), or polypeptide fusion construct(s), to a subject to induce an immune response against said HPV element. In one embodiment, the transgene encodes multiple HPV proteins, polypeptides peptides, or fusion constructs from selected hrHV types, where the HPV polypeptide sequences are selected to induce a cross-reactive immune response against additional hrHPV types in a human subject.

Terms

As used herein, a "high-risk" HPV type (hrHPV type) is one where cervical infection with that type is known to be associated with high-grade cervical intraepithelial neoplasia or cancer. As used herein, hrHPV types are 16, 18, 31, 33, 35, 39, 45, 51, 52, 56, 58, 59, 68, 73, and 82, which have been identified in the scientific literature as high-risk. "Low-risk" HPV types are those where cervical infection with that type has not been associated with high-grade cervical intra-epithelial neoplasia or cancer.

As used herein, the term "antigen" refers to a molecule containing one or more epitopes (e.g., linear, conformational or both) capable of stimulating a mammalian host's immune system to make a humoral and/or cellular antigen-specific immunological response (i.e. an immune response which specifically recognizes a naturally occurring polypeptide, e.g., a viral or bacterial protein). An "epitope" is that portion of an antigen that determines its immunological specificity. T- and B-cell epitopes can be identified empirically (e.g. using PEPSCAN or similar methods).

As used herein, an "HPV antigenic peptide" refers to a fragment of a naturally-occurring HPV protein of at least 10, 15, 20, 30, 40, 50, 60, 100, 200, 300 or more amino acids, or a peptide having an amino acid sequence of at least 85%, 90%, 95%, 97%, 98%, 99%, or 99.5% sequence identity to a naturally-occurring HPV protein (or to a fragment of a naturally-occurring HPV protein of at least about 10, 15, 20, 30, 40, 50, 60 or more amino acids). Thus an HPV antigenic peptide may be a fragment of a naturally occurring HPV protein, of at least 10 amino acids, and may comprise one or more amino acid substitutions, deletions or additions. "HPV antigenic peptides" are antigens as defined herein. Examples of full-length HPV16 E1, E2, E6 and E7 proteins are provided herein as SEQ ID NOs: 39, 40, 41 and 42, respectively. The amino acid sequences of Early proteins for additional HPV types are publicly available, e.g., via the GenBank™ genetic sequence database, National Center for Biotechnology Information (available at www(dot) ncbi.nlm.nih.gov/genbank/ (see also Nucleic Acids Research, January 2013: 41(D1):D36-42)).

As used herein, the term "fragment" as applied to a protein or peptide refers to a subsequence of a larger protein or peptide. A "fragment" of a protein or peptide is at least about 10 amino acids in length (amino acids naturally occurring as consecutive amino acids; e.g., as for a single linear epitope); for example at least about 15, 20, 30, 40, 50, 60, 100, 200, 300 or more amino acids in length (and any integer value in between). Antigenic HPV polypeptides may comprise two or more fragments of an HPV protein linked together.

As used herein, a peptide "fusion construct" or a "fusion protein" refers to a polypeptide comprising amino acid sequences (full-length sequence or fragments) from at least two distinct proteins. Thus, a fusion construct may contain two, three, or more sequences of the same protein from at least two HPV types (e.g., fragments of E6 protein from HPV 31 and HPV33), or sequences of different proteins from a single HPV type (e.g., fragments or full-length sequences of E1 and E7 proteins from HPV16). The sequences are typically covalently linked via a peptide bond, either directly or via an amino acid linker. The term may also refer to a protein comprising at least two sequences from distinct polypeptides that are linked non-covalently. The polypeptides forming the fusion protein are typically linked C-terminus to N-terminus, although they can also be linked C-terminus to C-terminus, N-terminus to N-terminus, or N-terminus to C-terminus. The polypeptides of the fusion protein can be in any order. The sequences in a peptide fusion construct may also contain amino acid substitutions, deletions or additions.

A peptide linker sequence may be employed to separate the polypeptide components of a fusion protein. Separation is by a distance sufficient to ensure that each polypeptide folds into functional secondary and tertiary structures. Such a peptide linker sequence is incorporated into the fusion protein using standard techniques known in the art. Suitable peptide linker sequences may be chosen based on the following factors: (1) their ability to adopt a flexible extended conformation; (2) their inability to adopt a secondary structure that could interact with functional epitopes on the first and second polypeptides; and (3) the lack of hydrophobic or charged residues that might react with the polypeptide functional epitopes. Preferred peptide linker sequences contain Gly, Asn and Ser residues. Other near neutral amino acids, such as Thr and Ala may also be used in the linker sequence. Amino acid sequences which may be usefully employed as linkers include those disclosed in Maratea et al., Gene 40:39-46 (1985); Murphy et al., Proc. Natl. Acad. Sci. USA 83:8258-8262 (1986); U.S. Pat. Nos. 4,935,233 and 4,751,180. The linker sequence may generally be from 1 to about 50 amino acids in length for example 1, 5, 10, 15, 20, 25, 30, 35 or 40 amino acids in length. Linker sequences are not required when the first and second polypeptides have non-essential N-terminal amino acid regions that can be used to separate the functional domains and prevent steric interference.

An HPV E protein (e.g., E1, E2, E6, or E7) may vary in amino acid sequence between different HPV strains. For this reason, the term 'equivalent amino acids,' or 'corresponding amino acids' refers to amino acids in a first sequence which correspond to those of an identified reference strain. A region of equivalent amino acids may be determined by aligning the amino acid sequences of the proteins from the different strains, using an alignment program such as BLAST® (available at blast.ncbi.nlm.nih.gov, last accessed 12 Sep. 2016).

As used herein, the terms "treat" and "treatment," as well as words stemming therefrom, are not meant to imply a "cure" of the condition being treated in all individuals, or 100% effective treatment in any given population. Rather, there are varying degrees of treatment which one of ordinary skill in the art recognizes as having beneficial therapeutic effect(s). In this respect, the inventive methods can provide any level of treatment of HPV-associated disease in a subject in need of such treatment, and may comprise elimination of an HPV infection, reduction in the severity or duration of one or more conditions or symptoms of HPV-associated disease, a delay in the progression of low-grade clinical disease (e.g., CIN1 or LSIL), or a reduction in the percentage of abnormal (dysplatic) cervical epithelial cells. The methods of the invention may simultaneously treat persistent cervical infection and low-grade HPV-related lesions, as infected cells may exist outside of identifiable lesions.

As used herein, "therapeutic immunization" or "therapeutic vaccination" refers to administration of the immunogenic compositions of the invention to a subject, preferably a human subject, who is known to be infected with HPV at the time of administration, to treat the HPV infection or HPV-related disease.

The terms polypeptide, peptide and protein are used interchangeably herein.

In one aspect, polynucleotides or polypeptides described herein are suitably isolated. An "isolated" polynucleotide or polypeptide is one that is removed from its original environment. An isolated antigenic HPV polypeptide is one that is removed from the HPV environment. An isolated antigenic HPV polypeptide 'from' a particular HPV protein is a polypeptide whose sequence aligns with a wild-type HPV sequence, optionally containing one, two, or more amino acid substitutions, deletions or insertions, such that the sequence of the isolated antigenic HPV polypeptide is at least 90%, 92%, 95%, 97%, 98%, 99% or 100% identical to the corresponding amino acids in the wild-type sequence. A polypeptide 'from' an HPV protein (or HPV type) does not mean the polypeptide has been removed from an intact protein (or HPV type), the polypeptide may be provided synthetically or recombinantly.

A naturally-occurring polynucleotide is isolated if it is separated from some or all of the coexisting materials in the natural system. A polynucleotide is considered to be isolated if, for example, it is cloned into a vector that is not a part of its natural environment or if it is comprised within cDNA.

In one aspect, the polynucleotides or polypeptides described herein are suitably recombinant. Recombinant means that the polynucleotide is the product of at least one of cloning, restriction or ligation steps, or other procedures that result in a polynucleotide that is distinct from a polynucleotide found in nature. A recombinant adenovirus is an adenovirus comprising a recombinant polynucleotide. A recombinant vector is a vector comprising a recombinant polynucleotide. A 'recombinant virus' includes progeny of the original recombinant virus. A 'recombinant vector' includes replicates of the original recombinant vector. A 'recombinant polynucleotide' includes replicates of the original recombinant polynucleotide.

As used herein, a polynucleotide introduced by genetic engineering techniques into a plasmid or vector derived from a different species (or different genus, subfamily or family) is a heterologous polynucleotide. A promoter removed from its native coding sequence and operatively linked to a coding sequence with which it is not naturally found linked is a heterologous promoter. A specific recombination site that has been cloned into a genome of a virus or viral vector, wherein the genome of the virus does not naturally contain it, is a heterologous recombination site. A heterologous nucleic acid sequence also includes a sequence naturally found in an adenoviral genome, but located at a non-native position within the adenoviral vector.

Typically, "heterologous" means derived from a genotypically distinct entity from that of the rest of the entity to which it is being compared. With regard to adenoviral vectors, a heterologous nucleic acid sequence refers to any nucleic acid sequence that is not isolated from, derived from, or based upon a naturally occurring nucleic acid sequence of the adenoviral vector. "Naturally occurring" means a sequence found in nature and not synthetically prepared or modified. A sequence is "derived" from a source when it is isolated from a source but modified (e.g., by deletion, substitution (mutation), insertion, or other modification), suitably so as not to disrupt the normal function of the source gene.

A "functional derivative" of a polypeptide suitably refers to a modified version of a polypeptide, e.g. wherein one or more amino acids of the polypeptide may be deleted, inserted, modified and/or substituted.

"Variant" as used herein, is a peptide sequence that differs in sequence from a reference peptide sequence, but retains essential properties of the reference molecule. Changes in the sequence of peptide variants are limited or conservative, so that the sequences of the reference peptide and the variant are closely similar overall and, in many regions, identical. A variant and reference peptide can differ in amino acid sequence by one or more substitutions, additions, deletions in any combination. A variant of a peptide can be naturally occurring such as an allelic variant, or can be a variant that is not known to occur naturally. Non-naturally occurring variants of nucleic acids and peptides may be made by mutagenesis techniques or by direct synthesis.

A "vector" is a replicon, such as plasmids, phagemids, cosmids, baculoviruses, bacmids, bacterial artificial chromosomes (BACs), yeast artificial chromosomes (YACs), as well as other bacterial, yeast and viral vectors, to which another nucleic acid segment may be operably inserted so as to bring about the replication or expression of the inserted segment. "Expression vector" refers to a vector comprising expression control sequences operatively linked to a nucleotide sequence to be expressed. An expression vector comprises sufficient cis-acting elements for expression; other elements for expression can be supplied by the host cell or in an in vitro expression system. Expression vectors include cosmids, plasmids, and viruses (e.g., lentiviruses, retroviruses, adenoviruses, and adeno-associated viruses) that incorporate the recombinant polynucleotide.

The term "simian" encompasses nonhuman primates, for example Old World monkeys, New World monkeys, apes and gibbons. In particular, simian may refer to nonhuman apes such as chimpanzees (*Pan troglodyte*), bonobos (*Pan paniscus*) and gorillas (genus *Gorilla*). Non-ape simians may include rhesus macaques (*Macaca mulatta*).

"Encoding" refers to the inherent property of specific sequences of nucleotides in a polynucleotide, to act as a template for synthesis of other polymers and macromolecules in biological processes, e.g., synthesis of peptides or proteins. Both the coding strand of a double-stranded nucleotide molecule (the sequence of which is usually provided in sequence listings), and the non-coding strand (used as the template for transcription of a gene or cDNA), can be referred to as encoding the peptide or protein. Unless otherwise specified, as used herein a "nucleotide sequence encoding an amino acid sequence" includes all nucleotide sequences that are degenerate versions of each other and that encode the same amino acid sequence.

The term "expression" or "expressing" as used herein is defined as the transcription and/or translation of a particular nucleotide sequence driven by its operably linked promoter.

Unless otherwise explained, all technical and scientific terms used herein have the same meaning as commonly understood by one of ordinary skill in the art to which this disclosure belongs. Definitions of common terms in molecular biology can be found in Benjamin Lewin, Genes V, published by Oxford University Press, 1994 (ISBN 0-19-854287-9); Kendrew et al. (eds.), *The Encyclopedia of Molecular Biology*, published by Blackwell Science Ltd., 1994 (ISBN 0-632-02182-9); and Robert A. Meyers (ed.), *Molecular Biology and Biotechnology: a Comprehensive Desk Reference*, published by VCH Publishers, Inc., 1995 (ISBN 1-56081-569-8).

The singular terms "a," "an," and "the" include plural referents unless context clearly indicates otherwise. Similarly, the word "or" is intended to include "and" unless the context clearly indicates otherwise. The term "plurality" refers to two or more. It is further to be understood that all base sizes or amino acid sizes, and all molecular weight or molecular mass values, given for nucleic acids or polypeptides are approximate, and are provided for description. Additionally, numerical limitations given with respect to concentrations or levels of a substance, such as an antigen, are intended to be approximate. Thus, where a concentration is indicated to be at least (for example) 200 pg, it is intended that the concentration be understood to be at least approximately (or "about" or "~") 200 pg.

Although methods and materials similar or equivalent to those described herein can be used in the practice or testing of this disclosure, suitable methods and materials are described below. The term "comprises" means "includes." Thus, unless the context requires otherwise, the word "comprises," and variations such as "comprise" and "comprising" will be understood to imply the inclusion of a stated compound or composition (e.g., nucleic acid, polypeptide, antigen) or step, or group of compounds or steps, but not to the exclusion of any other compounds, composition, steps, or groups thereof. The abbreviation, "e.g." is derived from the Latin exempli gratia, and is used herein to indicate a non-limiting example and is synonymous with the term "for example."

Amino acid sequences provided herein are designated by either single-letter or three-letter nomenclature, as is known in the art (see, e.g., Eur. J. Biochem. 138:9-37(1984)).

"Fusion protein" and "chimeric protein" are used interchangeably herein, and refer to a recombinant polypeptide sequence that comprises contiguous sequences from two separate proteins, i.e., two proteins encoded by different genes.

To facilitate review of the various embodiments of this disclosure, the preceeding explanations of terms are provided. Additional terms and explanations are provided in the context of this disclosure.

Sequence Comparison

For the purposes of comparing two closely-related polynucleotide or polypeptide sequences, the "sequence identity" or "% identity" between a first sequence and a second sequence may be calculated using an alignment program, such as BLAST® (available at blast.ncbi.nlm.nih.gov, last accessed 12 Sep. 2016) using standard settings. The percentage identity is the number of identical residues divided by the length of the alignment, multiplied by 100. An alternative definition of identity is the number of identical residues divided by the number of aligned residues, multiplied by 100. Alternative methods include using a gapped method in which gaps in the alignment, for example deletions in one sequence relative to the other sequence, are considered.

Sequences that preserve the functionality of the polynucleotide or a polypeptide encoded thereby are likely to be more closely identical. Polypeptide or polynucleotide sequences are said to be identical to other polypeptide or polynucleotide sequences, if they share 100% sequence identity over their entire length.

A "difference" between two sequences refers to an insertion, deletion or substitution, e.g., of a single amino acid residue in a position of one sequence, compared to the other sequence.

For the purposes of comparing a first, reference polypeptide sequence to a second, comparison polypeptide sequence, the number of additions, substitutions and/or deletions made to the first sequence to produce the second sequence may be ascertained. An addition is the addition of one amino acid residue into the sequence of the first polypeptide (including addition at either terminus of the first polypeptide). A substitution is the substitution of one amino acid residue in the sequence of the first polypeptide with one different amino acid residue. A deletion is the deletion of one amino acid residue from the sequence of the first polypeptide (including deletion at either terminus of the first polypeptide).

Suitably substitutions in the sequences of the present invention may be conservative substitutions. A conservative substitution comprises the substitution of an amino acid with another amino acid having a physic-chemical property similar to the amino acid that is substituted (see, for example, Stryer et al, *Biochemistry*, 5$^{th}$ Edition 2002, pages 44-49). Preferably, the conservative substitution is a substitution selected from the group consisting of: (i) a substitution of a basic amino acid with another, different basic amino acid; (ii) a substitution of an acidic amino acid with another, different acidic amino acid; (iii) a substitution of an aromatic amino acid with another, different aromatic amino acid; (iv) a substitution of a non-polar, aliphatic amino acid with another, different non-polar, aliphatic amino acid; and (v) a substitution of a polar, uncharged amino acid with another, different polar, uncharged amino acid. A basic amino acid is preferably selected from the group consisting of arginine, histidine, and lysine. An acidic amino acid is preferably aspartate or glutamate. An aromatic amino acid is preferably selected from the group consisting of phenylalanine, tyrosine and tryptophane. A non-polar, aliphatic amino acid is preferably selected from the group consisting of glycine, alanine, valine, leucine, methionine and isoleucine. A polar, uncharged amino acid is preferably selected from the group consisting of serine, threonine, cysteine, proline, asparagine and glutamine. In contrast to a conservative amino acid substitution, a non-conservative amino acid substitution is the exchange of one amino acid with any amino acid that does not fall under the above-outlined conservative substitutions (i) through (v).

Vectors and Recombinant Adenovirus

A vector may be any suitable nucleic acid molecule including naked DNA, a plasmid, a virus, a cosmid, phage vector such as lambda vector, an artificial chromosome such as a BAC (bacterial artificial chromosome), or an episome. Alternatively, a vector may be a transcription and/or expression unit for cell-free in vitro transcription or expression, such as a T7-compatible system. The vectors may be used alone or in combination with other vectors such as adenoviral sequences or fragments, or in combination with elements from non-adenoviral sequences.

The ChAd155 sequences described herein are useful in the construction of a variety of vector systems, recombinant adenovirus and host cells. Suitably the term "vector" refers to a nucleic acid that (a) has been substantially altered (e.g., having a gene or functional region deleted and/or inactivated) relative to a wild type sequence, and/or that incorporates a heterologous sequence, i.e., a nucleic acid obtained from a different source (also called an "insert"), and (b) replicates and/or expresses the inserted polynucleotide sequence, when introduced into a cell (e.g., a host cell). For example, the insert may be all or part of the ChAd155 sequences described herein.

Alternatively, a ChAd155 vector is a ChAd155 adenovirus comprising one or more deletions or inactivations of viral genes, such as E1 or another viral gene or functional region described herein. Such a ChAd155, which may or may not comprise a heterologous sequence, is often called a "backbone" and may be used as is or as a starting point for additional modifications to the vector.

The term "replication-competent" adenovirus refers to an adenovirus which can replicate in a host cell in the absence of any recombinant helper proteins comprised in the cell. Suitably, a "replication-competent" adenovirus comprises the following intact or functional essential early genes: E1A, E1B, E2A, E2B, E3 and E4. Wild type adenoviruses isolated from a particular animal will be replication competent in that animal.

The term "replication-incompetent" or "replication-defective" adenovirus refers to an adenovirus which is incapable of replication because it has been engineered to comprise at least a functional deletion (or "loss-of-function" mutation), i.e. a deletion or mutation which impairs the function of a gene without removing it entirely (such as introduction of artificial stop codons, deletion or mutation of active sites or interaction domains, mutation or deletion of a regulatory sequence of a gene etc, or a complete removal of a gene encoding a gene product that is essential for viral replication, such as one or more of the adenoviral genes selected from E1A, E1B, E2A, E2B, E3 and E4 (such as E3 ORF1, E3 ORF2, E3 ORF3, E3 ORF4, E3 ORF5, E3 ORF6, E3 ORF7, E3 ORF8, E3 ORF9, E4 ORF7, E4 ORF6, E4 ORF4, E4 ORF3, E4 ORF2 and/or E4 ORF1). Particularly suitably E1 and optionally E3 and/or E4 are deleted. If deleted, the aforementioned deleted adenoviral gene region will suitably not be considered in the alignment when determining % identity with respect to another sequence.

The present invention provides vectors such as recombinant adenovirus containing inserts capable of expressing HPV protein(s), antigenic peptide(s) or peptide fusion constructs, in mammalian, such as human, cells. Such vectors contain DNA of ChAd155 as disclosed herein and a minigene. By "minigene" (or "expression cassette") is meant the combination of a selected polynucleotide sequence ("transgene") encoding a heterologous peptide sequence, and the other regulatory elements necessary to drive translation, transcription and/or expression of the gene product in a host cell.

Typically, a ChAd155-derived adenoviral vector is designed such that the minigene is located in a nucleic acid molecule which contains other adenoviral sequences in the region native to a selected adenoviral gene. The minigene may be inserted into an existing gene region to disrupt the function of that region, if desired. Alternatively, the minigene may be inserted into the site of a partially or fully deleted adenoviral gene. For example, the minigene may be located in the site of a mutation, insertion or deletion which renders non-functional at least one gene of a genomic region selected from the group consisting of E1A, E1B, E2A, E2B, E3 and E4. The term "renders non-functional" means that a sufficient amount of the adenoviral gene region is removed or otherwise disrupted, so that the gene region is no longer capable of producing functional products of gene expression. If desired, the entire gene region may be removed (and suitably replaced with the minigene).

For example, for a production vector useful for generation of a recombinant virus, the vector may contain the minigene and either the 5' end of the adenoviral genome or the 3' end of the adenoviral genome, or both the 5' and 3' ends of the adenoviral genome. The 5' end of the adenoviral genome contains the 5 ' cis-elements necessary for packaging and replication; i.e., the 5' ITR sequences (which function as origins of replication) and the native 5 ' packaging enhancer domains (that contain sequences necessary for packaging linear Ad genomes and enhancer elements for the E1 promoter). The 3' end of the adenoviral genome includes the 3 ' cis-elements (including the ITRs) necessary for packaging and encapsidation. Suitably, a recombinant adenovirus contains both 5' and 3' adenoviral cis-elements and the minigene (suitably containing a transgene) is located between the 5' and 3' adenoviral sequences. A ChAd155-based adenoviral vector may also contain additional adenoviral sequences.

Suitably, ChAd155-based vectors contain one or more adenoviral elements derived from the adenoviral ChAd155 genome as described herein. In one embodiment, the vectors contain adenoviral ITRs from ChAd155 and additional adenoviral sequences from the same adenoviral serotype. In another embodiment, the vectors contain adenoviral sequences that are derived from a different adenoviral serotype than that which provides the ITRs.

As defined herein, a pseudotyped adenovirus refers to an adenovirus in which the capsid proteins of the adenovirus are from a different adenovirus than the adenovirus which provides the ITRs.

Further, chimeric or hybrid adenoviruses may be constructed using the adenoviruses described herein using techniques known to those of skill in the art (see e.g., U.S. Pat. No. 7,291,498).

ITRs and any other adenoviral sequences present in the adenoviral vectors of the present invention may be obtained from many sources. A variety of adenovirus strains are available from the American Type Culture Collection, Manassas, Va., or available by request from a variety of commercial and institutional sources. Further, the sequences of many such strains are available from a variety of databases including, e.g., PubMed and GenBank. Homologous adenovirus vectors prepared from other chimp or from human adenoviruses are described in the published literature (for example, U.S. Pat. No. 5,240,846). The DNA sequences of a number of adenovirus types are available from GenBank, including type Ad5 (GenBank Accession Number M73370). The adenovirus sequences may be obtained from any known adenovirus serotype, such as serotypes 2, 3, 4, 7, 12 and 40, and further including any of the presently identified human types. Similarly adenoviruses known to infect nonhuman animals (e.g., simians) may also be employed in the vector constructs of this invention (e.g., U.S. Pat. No. 6,083,716). The viral sequences, helper viruses (if needed), and recombinant viral particles, and other vector components and sequences employed in the construction of the vectors described herein may be obtained as described below.

Adenoviral plasmids (or other vectors) may be used to produce adenoviral vectors. In one embodiment, the adenoviral vectors are adenoviral particles which are replication-incompetent. In one embodiment, the adenoviral particles are rendered replication-incompetent by deletions in the E1A and/or E1B genes. Alternatively, the adenoviruses are rendered replication-incompetent by another means, and may retain the E1A and/or E1B genes. Similarly, in some embodiments, reduction of an immune response to the vector may be accomplished by deletions in the adenoviral E2B and/or DNA polymerase genes. The adenoviral vectors can also contain other mutations to the adenoviral genome, e.g., temperature-sensitive mutations or deletions in other genes. In other embodiments, it is desirable to retain an intact E1A and/or E1B region in the adenoviral vectors. Such an intact E1 region may be located in its native location in the adenoviral genome or placed in the site of a deletion in the native adenoviral genome (e.g., in the E3 region).

In the construction of adenovirus vectors for delivery of HPV proteins, antigenic peptides, or fusion peptides to a mammalian (such as a human) cell, a range of modified adenovirus nucleic acid sequences can be employed in the vectors. For example, all or a portion of the adenovirus delayed early gene E3 may be eliminated from the adenovirus sequence which forms a part of the recombinant virus. The function of adenoviral E3 is believed to be irrelevant to the function and production of the recombinant virus particle. Adenovirus vectors may also be constructed having a deletion of at least the ORF6 region of the E4 gene, and more desirably because of the redundancy in the function of this region, the entire E4 region. Still another vector of the invention contains a deletion in the adenoviral delayed early gene E2A. Deletions may also be made in any of the late genes L1 to L5 of the adenovirus genome. Similarly, deletions in the intermediate genes IX and IVa2 may be useful for some purposes. Other deletions may be made in the other structural or non-structural adenovirus genes. The above discussed deletions may be used individually, i.e., an adenovirus sequence for use as described herein may contain deletions in only a single region. Alternatively, deletions of entire genes or portions thereof effective to destroy their biological activity may be used in any combination. For example, in one exemplary vector, the adenovirus sequence may have deletions of the E1 genes and the E4 gene, or of the E1, E2A and E3 genes, or of the E1 and E3 genes, or of E1, E2A and E4 genes, with or without deletion of E3, and so on. Any one or more of the E genes may suitably be replaced with an E gene (or one or more E gene open reading frames) sourced from a different strain of adenovirus. Particularly suitably the ChAd155 E1 and E3 genes are deleted and the ChAd155E4 gene is replaced with E4Ad5orf6. As discussed above, such deletions and/or substitutions may be used in combination with other mutations, such as temperature-sensitive mutations, to achieve a desired result.

An adenoviral vector lacking one or more essential adenoviral sequences (e.g., E1 A, E1B, E2A, E2B, E4 ORF6, L1, L2, L3, L4 and L5) may be cultured in the presence of the missing adenoviral gene products which are required for viral infectivity and propagation of an adenoviral particle. These helper functions may be provided by culturing the adenoviral vector in the presence of one or more helper constructs (e.g., a plasmid or virus) or a packaging host cell.

Complementation of Replication-Incompetent Vectors

To generate recombinant adenoviruses deleted in any of the genes described above, the function of the deleted gene region, if essential to the replication and infectivity of the virus, must be supplied to the recombinant virus by a helper virus or cell line, i.e., a complementation or packaging cell line.

Helper Viruses: Depending upon the adenovirus gene content of the viral vectors employed to carry the minigene, a helper adenovirus or non-replicating virus fragment may be used to provide sufficient adenovirus gene sequences necessary to produce an infective recombinant viral particle containing the minigene. Useful helper viruses contain selected adenovirus gene sequences not present in the adenovirus vector construct and/or not expressed by the packaging cell line in which the vector is transfected. In one embodiment, the helper virus is replication-defective and contains adenovirus genes in addition, suitably, to one or more of the sequences described herein. Such a helper virus is suitably used in combination with an E1 expressing (and optionally additionally E3 expressing) cell line.

A helper virus may optionally contain a reporter gene. A number of such reporter genes are known to the art as well as described herein. The presence of a reporter gene on the helper virus which is different from the transgene on the adenovirus vector allows both the adenoviral vector and the helper virus to be independently monitored. This reporter is used to enable separation between the resulting recombinant virus and the helper virus upon purification.

Complementation Cell Lines:

In many circumstances, a cell line expressing the one or more missing genes which are essential to the replication and infectivity of the virus, such as human E1, can be used to transcomplement a chimp adenoviral vector. This is particularly advantageous because, due to the diversity between the chimp adenovirus sequences as disclosed herein and the human adenovirus sequences found in currently available packaging cells, the use of the current human E1-containing cells prevents the generation of replication-competent adenoviruses during the replication and production process.

Alternatively, if desired, one may utilize the sequences provided herein to generate a packaging cell or cell line that expresses, at a minimum, the E1 gene from ChAd155 under the transcriptional control of a promoter for expression in a selected parent cell line. Inducible or constitutive promoters may be employed for this purpose. Examples of such promoters are described in detail elsewhere in this document. A parent cell is selected for the generation of a novel cell line expressing any desired ChAd155 gene. Without limitation, such a parent cell line may be A549 [ATCC Accession No. CCL 185], HEK 293, KB [CCL 17], Detroit [e.g., Detroit 510, CCL 72] and WI-38 [CCL 75] cells, among others. These cell lines are all available from the American Type Culture Collection, 10801 University Boulevard, Manassas, Va. 20110-2209.

Such E1-expressing cell lines are useful in the generation of recombinant adenovirus E1 deleted vectors. Additionally, or alternatively, cell lines that express one or more adenoviral gene products, e.g., E1A, E1B, E2A, E3 and/or E4, can be constructed using essentially the same procedures as used in the generation of recombinant viral vectors. Such cell lines can be utilised to transcomplement adenovirus vectors deleted in the essential genes that encode those products, or to provide helper functions necessary for packaging of a helper-dependent virus (e.g., adeno-associated virus). The preparation of a host cell involves techniques such as assembly of selected DNA sequences.

In another alternative, the essential adenoviral gene products are provided in trans by the adenoviral vector and/or helper virus. In such an instance, a suitable host cell can be selected from any biological organism, including prokaryotic (e.g., bacterial) cells, and eukaryotic cells, including, insect cells, yeast cells and mammalian cells.

Host cells may be selected from among any mammalian species, including, without limitation, cells such as A549, WEHI, 3T3, 10n/2, HEK 293 cells or Per.C6 (both of which express functional adenoviral E1) (Fallaux, 1998), Saos, C2C12, L cells, HT1080, HepG2 and primary fibroblast, hepatocyte and myoblast cells derived from mammals including human, monkey, mouse, rat, rabbit, and hamster.

A particularly suitable complementation cell line is the Procell92 cell line. The Procell92 cell line is based on HEK 293 cells which express adenoviral E1 genes, transfected with the Tet repressor under control of the human phosphoglycerate kinase-1 (PGK) promoter, and the G418-resistance gene (Vitelli et al. (2013)). Procell92.S is adapted for growth in suspension conditions and is useful for producing adenoviral vectors expressing toxic proteins (www.okairos.com/e/inners.php?m=00084, last accessed 10 Aug. 2016).

Assembly of a Viral Particle and Transfection of a Cell Line: Generally, when delivering a vector comprising a minigene by transfection, the vector is delivered in an amount from about 5 μg to about 100 μg DNA, and preferably about 10 to about 50 μg DNA to about $1 \times 10^4$ cells to about $1 \times 10^{13}$ cells, and preferably about $10^5$ cells. However, the relative amounts of vector DNA to host cells may be adjusted, taking into consideration such factors as the selected vector, the delivery method and the host cells selected.

Introduction of the vector into the host cell may be achieved by any means known in the art, including transfection, and infection. One or more of the adenoviral genes may be stably integrated into the genome of the host cell, stably expressed as episomes, or expressed transiently. The gene products may all be expressed transiently, on an episome or stably integrated, or some of the gene products may be expressed stably while others are expressed transiently.

Introduction of vectors into the host cell may also be accomplished using techniques known to the skilled person. Suitably, standard transfection techniques are used, e.g., CaPC transfection or electroporation.

Assembly of the selected DNA sequences of the adenovirus (as well as the transgene and other vector elements) into various intermediate plasmids, and the use of the plasmids and vectors to produce a recombinant viral particle are all achieved using conventional techniques. Such techniques include conventional cloning techniques of cDNA, use of overlapping oligonucleotide sequences of the adenovirus genomes, polymerase chain reaction, and any suitable method which provides the desired nucleotide sequence. Standard transfection and co-transfection techniques are employed, e.g., CaPC precipitation techniques. Other conventional methods employed include homologous recombination of the viral genomes, plaquing of viruses in agar overlay, methods of measuring signal generation, and the like.

For example, following the construction and assembly of the desired minigene-containing viral vector, the vector is transfected in vitro in the presence of a helper virus into the packaging cell line. Homologous recombination occurs between the helper and the vector sequences, which permits the adenovirus-transgene sequences in the vector to be replicated and packaged into virion capsids, resulting in the recombinant viral vector particles. The resulting recombinant adenoviruses are useful in transferring a selected transgene to a selected cell. In in vivo experiments with recombinant virus grown in the packaging cell lines, the E1-deleted recombinant ChAd155 adenoviral vectors demonstrate utility in transferring a transgene to a non-simian mammalian cell.

Self-Replicating RNA (or "SAM") Vectors

In one embodiment, the recombinant vector(s) according to the invention are RNA vectors. Suitably, the RNA-based vaccine comprises a self-replicating RNA molecule. The self-replicating RNA molecule may be an alphavirus-derived RNA replicon.

Self-replicating RNA (or "SAM") molecules are well known in the art and can be produced by using replication elements derived from, e.g., alphaviruses, and substituting the structural viral proteins with a nucleotide sequence encoding a protein of interest. A self-replicating RNA molecule is typically a +-strand molecule which can be directly translated after delivery to a cell, and this translation provides a RNA-dependent RNA polymerase which then produces both antisense and sense transcripts from the delivered RNA. Thus, the delivered RNA leads to the production of multiple daughter RNAs. These daughter RNAs, as well as collinear subgenomic transcripts, may be translated themselves to provide in situ expression of an encoded polypeptide (i.e. comprising HPV antigens), or may be transcribed to provide further transcripts with the same sense as the delivered RNA which are translated to provide in situ expression of the antigen. The overall result of this sequence of transcriptions is a huge amplification in the number of the introduced replicon RNAs and so the encoded antigen becomes a major polypeptide product of the cells.

One suitable system for achieving self-replication in this manner is to use an alphavirus-based replicon. These replicons are +-stranded RNAs which lead to translation of a replicase (or replicase-transcriptase) after delivery to a cell. The replicase is translated as a polyprotein which auto-cleaves to provide a replication complex which creates genomic-strand copies of the +-strand delivered RNA. These −-strand transcripts can themselves be transcribed to give further copies of the +-stranded parent RNA and also to give a subgenomic transcript which encodes the antigen. Translation of the subgenomic transcript thus leads to in situ expression of the antigen by the infected cell. Suitable alphavirus replicons can use a replicase from a Sindbis virus, a Semliki forest virus, an eastern equine encephalitis virus, a Venezuelan equine encephalitis virus, etc. Mutant or wild-type virus sequences can be used e.g. the attenuated TC83 mutant of VEEV has been used in replicons, see the following reference: WO2005/113782.

In certain embodiments, the self-replicating RNA molecule described herein encodes (i) a RNA-dependent RNA polymerase which can transcribe RNA from the self-replicating RNA molecule and (ii) a HPV antigen. The polymerase can be an alphavirus replicase e.g. comprising one or more of alphavirus proteins nsP1, nsP2, nsP3 and nsP4.

Whereas natural alphavirus genomes encode structural virion proteins in addition to the non-structural replicase polyprotein, in certain embodiments, the self-replicating RNA molecules do not encode alphavirus structural proteins. Thus, the self-replicating RNA can lead to the production of genomic RNA copies of itself in a cell, but not to the production of RNA-containing virions. The inability to produce these virions means that, unlike a wild-type alphavirus, the self-replicating RNA molecule cannot perpetuate itself in infectious form. The alphavirus structural proteins which are necessary for perpetuation in wild-type viruses are absent from self-replicating RNAs of the present disclosure and their place is taken by gene(s) encoding the immunogen of interest, such that the subgenomic transcript encodes the immunogen rather than the structural alphavirus virion proteins.

Thus, a self-replicating RNA molecule useful with the invention may have two open reading frames. The first (5') open reading frame encodes a replicase; the second (3') open reading frame encodes an antigen. In some embodiments, the RNA may have additional (e.g. downstream) open reading frames e.g. to encode further antigens or to encode accessory polypeptides.

In certain embodiments, the self-replicating RNA molecule disclosed herein has a 5' cap (e.g. a 7-methylguanosine). This cap can enhance in vivo translation of the RNA. In some embodiments, the 5' sequence of the self-replicating RNA molecule must be selected to ensure compatibility with the encoded replicase.

A self-replicating RNA molecule may have a 3' poly-A tail. It may also include a poly-A polymerase recognition sequence (e.g. AAUAAA) near its 3' end.

Self-replicating RNA molecules can have various lengths but they are typically 5000-25000 nucleotides long. Self-replicating RNA molecules will typically be single-stranded. Single-stranded RNAs can generally initiate an adjuvant effect by binding to TLR7, TLR8, RNA helicases and/or PKR. RNA delivered in double-stranded form (dsRNA) can bind to TLR3, and this receptor can also be triggered by dsRNA which is formed either during replication of a single-stranded RNA or within the secondary structure of a single-stranded RNA.

The self-replicating RNA can conveniently be prepared by in vitro transcription (IVT). IVT can use a (cDNA) template created and propagated in plasmid form in bacteria, or created synthetically (for example by gene synthesis and/or polymerase chain-reaction (PCR) engineering methods). For instance, a DNA-dependent RNA polymerase (such as the bacteriophage T7, T3 or SP6 RNA polymerases) can be used to transcribe the self-replicating RNA from a DNA template. Appropriate capping and poly-A addition reactions can be used as required (although the replicon's poly-A is usually encoded within the DNA template). These RNA polymerases can have stringent requirements for the transcribed 5' nucleotide(s) and in some embodiments these requirements must be matched with the requirements of the encoded replicase, to ensure that the IVT-transcribed RNA can function efficiently as a substrate for its self-encoded replicase.

A self-replicating RNA can include (in addition to any 5' cap structure) one or more nucleotides having a modified nucleobase. A RNA used with the invention ideally includes only phosphodiester linkages between nucleosides, but in some embodiments, it can contain phosphoramidate, phosphorothioate, and/or methylphosphonate linkages.

The self-replicating RNA molecule may encode a single heterologous polypeptide antigen or two or more heterologous antigens linked together in a way that each of the sequences retains its identity (e.g. HPV antigens) when expressed as an amino acid sequence. The heterologous polypeptides generated from the self-replicating RNA may then be produced as a fusion polypeptide or engineered in such a manner to result in separate polypeptide or peptide sequences.

The self-replicating RNA molecules described herein may be engineered to express multiple nucleotide sequences or transgenes, from two or more open reading frames, thereby allowing co-expression of proteins, such as one, two or more HPV antigens (e.g. one, two, three, four or five HPV antigen) together with cytokines or other immunomodulators, which can enhance the generation of an immune response. Such a self-replicating RNA molecule might be particularly useful, for example, in the production of various gene products (e.g., proteins) at the same time, for example, as a bivalent or multivalent vaccine.

If desired, the self-replicating RNA molecules can be screened or analyzed to confirm their therapeutic and prophylactic properties using various in vitro or in vivo testing methods that are known to those of skill in the art. For example, vaccines comprising self-replicating RNA molecule can be tested for their effect on induction of proliferation or effector function of the particular lymphocyte type of interest, e.g., B cells, T cells, T cell lines, and T cell clones. For example, spleen cells from immunized mice can be isolated and the capacity of cytotoxic T lymphocytes to lyse autologous target cells that contain a self-replicating RNA molecule that encodes HPV antigen. In addition, T helper cell differentiation can be analyzed by measuring proliferation or production of TH1 (IL-2 and IFN-γ) and/or TH2 (IL-4 and IL-5) cytokines by ELISA or directly in CD4+ T cells by cytoplasmic cytokine staining and flow cytometry.

Self-replicating RNA molecules that encode one or more HPV antigenic polypeptides can also be tested for ability to induce humoral immune responses, as evidenced, for example, by induction of B cell production of antibodies specific for an HPV antigen of interest. These assays can be conducted using, for example, peripheral B lymphocytes from immunized individuals. Such assay methods are known to those of skill in the art. Other assays that can be used to characterize the self-replicating RNA molecules can involve detecting expression of the encoded HPV antigen by the target cells. For example, FACS can be used to detect antigen expression on the cell surface or intracellularly. Another advantage of FACS selection is that one can sort for different levels of expression; sometimes-lower expression may be desired. Other suitable method for identifying cells which express a particular antigen involve panning using monoclonal antibodies on a plate or capture using magnetic beads coated with monoclonal antibodies.

In some embodiments, the self-replicating RNA molecules comprise a sequence which is at least 70%, at least 75%, at least 80%, at least 85%, at least 90%, at least 95%, at least 96%, at least 97%, at least 98%, or at least 99% identical to a sequence selected from the group consisting of SEQ ID NO:150, SEQ ID NO:152 or SEQ ID NO:154. In some embodiments, the self-replicating RNA molecule comprises a fragment of a full-length sequence selected from the group consisting of SEQ ID NO:150, SEQ ID NO:152 or SEQ ID NO:154? wherein the fragment comprises a contiguous stretch of the nucleic acid sequence of the full-length sequence up to 1, 2, 3, 4, 5, 6, 7, 8, 9, 10, 15, 20, 25, or 30 nucleic acids shorter than full-length sequence.

In some embodiments, a DNA sequence encoding a self-replicating RNA molecule is provided, such as a DNA sequence encoding a self-replicating RNA molecule comprises a sequence which is at least 70%, at least 75%, at least 80%, at least 85%, at least 90%, at least 95%, at least 96%, at least 97%, at least 98%, or at least 99% identical to a sequence selected from the group consisting of SEQ ID NO:149, SEQ ID NO:151 or SEQ ID NO:153. In some embodiments, the DNA sequence encoding a self-replicating RNA molecule comprises a fragment of a full-length sequence selected from the group consisting of SEQ ID NO:149, SEQ ID NO:151 or SEQ ID NO:153 wherein the fragment comprises a contiguous stretch of the nucleic acid sequence of the full-length sequence up to 1, 2, 3, 4, 5, 6, 7, 8, 9, 10, 15, 20, 25, or 30 nucleic acids shorter than full-length sequence.

The nucleic acid-based composition comprising the RNA-based constructs may comprise a viral or a non-viral delivery system. The delivery system (also referred to herein as a delivery vehicle) may have adjuvant effects which enhance the immunogenicity of the encoded HPV antigen. For example, the nucleic acid molecule may be encapsulated in liposomes, non-toxic biodegradable polymeric microparticles or viral replicon particles (VRPs), or complexed with particles of a cationic oil-in-water emulsion. In some embodiments, the nucleic acid-based vaccine comprises a cationic nano-emulsion (CNE) delivery system or a lipid nanoparticle (LNP) delivery system. In some embodiments, the nucleic acid-based vaccine comprises a non-viral delivery system, i.e., the nucleic acid-based vaccine is substantially free of viral capsid. Alternatively, the nucleic acid-based vaccine may comprise viral replicon particles. In other embodiments, the nucleic acid-based vaccine may comprise a naked nucleic acid, such as naked RNA (e.g. mRNA), but delivery via CNEs or LNPs is preferred.

In certain embodiments, the nucleic acid-based vaccine comprises a cationic nano-emulsion (CNE) delivery system. CNE delivery systems and methods for their preparation are described in the following reference: WO2012/006380. In a CNE delivery system, the nucleic acid molecule (e.g. RNA) which encodes the antigen is complexed with a particle of a cationic oil-in-water emulsion. Cationic oil-in-water emulsions can be used to deliver negatively charged molecules, such as an RNA molecule to cells. The emulsion particles comprise an oil core and a cationic lipid. The cationic lipid can interact with the negatively charged molecule thereby anchoring the molecule to the emulsion particles. Further details of useful CNEs can be found in the following references: WO2012/006380; WO2013/006834; and WO2013/006837 (the contents of each of which are incorporated herein in their entirety).

Thus, in a nucleic acid-based vaccine of the invention, an RNA molecule encoding a HPV antigenic polypeptides may be complexed with a particle of a cationic oil-in-water emulsion. The particles typically comprise an oil core (e.g. a plant oil or squalene) that is in liquid phase at 25° C., a cationic lipid (e.g. phospholipid) and, optionally, a surfactant (e.g. sorbitan trioleate, polysorbate 80); polyethylene glycol can also be included. In some embodiments, the CNE comprises squalene and a cationic lipid, such as 1,2-dioleoyloxy-3-(trimethylammonio)propane (DOTAP). In some preferred embodiments, the delivery system is a non-viral delivery system, such as CNE, and the nucleic acid-based vaccine comprises a self-replicating RNA (mRNA). This may be particularly effective in eliciting humoral and cellular immune responses. Advantages also include the absence of a limiting anti-vector immune response and a lack of risk of genomic integration.

LNP delivery systems and non-toxic biodegradable polymeric microparticles, and methods for their preparation are described in the following references: WO2012/006376 (LNP and microparticle delivery systems); Geall et al. (2012) PNAS USA. September 4; 109(36): 14604-9 (LNP delivery system); and WO2012/006359 (microparticle delivery systems). LNPs are non-virion liposome particles in which a nucleic acid molecule (e.g. RNA) can be encapsulated. The particles can include some external RNA (e.g. on the surface of the particles), but at least half of the RNA (and ideally all of it) is encapsulated. Liposomal particles can, for example, be formed of a mixture of zwitterionic, cationic and anionic lipids which can be saturated or unsaturated, for example; DSPC (zwitterionic, saturated), DlinDMA (cationic, unsaturated), and/or DMG (anionic, saturated). Preferred LNPs for use with the invention include an amphiphilic lipid which can form liposomes, optionally in combination with at least one cationic lipid (such as DOTAP, DSDMA, DODMA, DLinDMA, DLenDMA, etc.). A mixture of DSPC, DlinDMA, PEG-DMG and cholesterol is particularly effective. Other useful LNPs are described in the following references: WO2012/006376; WO2012/030901; WO2012/031046; WO2012/031043; WO2012/006378; WO2011/076807; WO2013/033563; WO2013/006825; WO2014/136086; WO2015/095340; WO2015/095346; WO2016/037053. In some embodiments, the LNPs are RV01 liposomes, see the following references: WO2012/006376 and Geall et al. (2012) PNAS USA. September 4; 109(36): 14604-9.

Transgenes

The transgene is a nucleic acid sequence, heterologous to the vector sequences flanking the transgene, which encodes protein(s) or peptide(s) of interest, including, e.g. a protein having a therapeutic effect when delivered to a subject in need of treatment. The transgene nucleic acid coding sequence is operatively linked to regulatory components in a manner which permits transgene transcription, translation, and/or expression in a host cell. HPV transgenes as disclosed herein may be used for induction of an immune response in order to treat HPV-related disease (a therapeutic vaccine). As used herein, induction of an immune response refers to the ability of a protein to induce a T cell and/or a humoral immune response to the protein.

The transgene sequences of the present invention are designed to encode multiple antigenic HPV polypeptide sequences (or to encode one or more polypeptides comprising multiple linked antigenic HPV peptide sequences). The antigenic HPV peptide(s) comprise fragment(s) of HPV Early proteins from fewer than all of the hrHPV types (as defined herein), where the antigenic HPV peptides are selected or designed to include sequences that are conserved across multiple high-risk HPV types, and to include CD8 and/or CD4 T-cell epitopes. Such sequences increase the ability of the transgene to induce cross-reactive or immune response to multiple hrHPV types when administered to a mammalian subject such as a human, including inducing immune responses to 'additional' hrHPV types (i.e., those hrHPV types that are not represented in the transgene).

Cross-reactivity to additional hrHPV types is obtained by: analyzing the sequence of an HPV early protein from a first hrHPV type and selecting regions (e.g., fragments) of that protein with high levels of identity and/or similarity across multiple hrHPV types (see Tables 9, 14, and 17 herein). This process may be repeated for additional early proteins from the first hrHPV type, and repeated for HPV early proteins from a second, third, fourth, fifth, sixth, seventh and/or eighth hrHPV type ('selected' HPV types). The vaccine vector constructs of the present invention are designed to provide a group of antigenic polypeptides that include polypeptides having at least about 60% sequence similarity, at least about 70% sequence identity, at least about 75% sequence identity, at least about 80% or higher sequence identity to corresponding early proteins from additional (non-selected) hrHPV types. Where an adenoviral vector is utilized in the methods of the present invention, the antigenic peptides and the vector are chosen so that adequate expression of the antigenic polypeptides is achieved for the intended purpose.

The amino acid sequences of full-length HPV16 E1, E2, E6 and E7 proteins are provided herein as SEQ ID NOs: 39, 40, 41 and 42, respectively. The amino acid sequences of Early proteins for additional HPV types are publicly available, e.g., via the GenBank™ genetic sequence database, National Center for Biotechnology Information (available at www(dot)ncbi.nlm.nih.gov/genbank/(see also Nucleic Acids Research, January 2013: 41(D1):D36-42)).

Stated another way, the method of the present invention comprises administration of a vector (or co-administration of two or more vectors) expressing antigenic polypeptides from HPV Early2 and Early 6 proteins, from fewer than all fifteen hrHPV types (i.e., from a selected subset of the fifteen hrHPV types identified herein), such that the expressed polypeptides include polypeptides having at least about 70% identity with the corresponding region of the E2 and/or E6 protein of at least one additional (i.e., non-selected) hrHPV type. See, e.g., Table 9 where a combination of E2 and E6 antigenic sequences from HPV16, 18, 58, 56 and 73 provided sequences having at least 70% sequence identity to E2 and/or E6 proteins of HPV31, 33, 45, 52, 35 and 82. The vectors used in the present invention may further express antigenic polypeptides from the E1 and/or E7 proteins of the selected hrHPV types, to provide polypeptides having at least about 70% identity with the corresponding region of the E1 and/or E7 protein of at least one additional (non-selected) hrHPV type.

In one embodiment, the method of the present invention comprises administration of a vector (or co-administration of two vectors, or more than two vectors) that expresses (a) antigenic polypeptides from each of E1, E2, E6 and E7 of HPV16 and HPV18, and (b) additional antigenic polypeptides from E1, E2, E6 and/or E7 from an additional one, two, three, four, five or six hrHPV types; such that for each of the fifteen hrHPV types identified herein, at least one antigenic polypeptide is administered that has at least 70% sequence identity to at least one of the hrHPV E1, E2, E6 or E7 proteins.

In a further embodiment, the method of the present invention comprises administration of a vector (or co-administration of two vectors, or more than two vectors) that expresses (a) antigenic polypeptides from each of E1, E2, E6 and E7 of HPV16 and HPV18, and (b) additional antigenic polypeptides from E1, E2, and/or E6 from HPV31, 33, 45, 52 and 58; such that antigenic polypeptides having at least about 70% similarity to at least two of the E1, E2 and E6 early proteins from each of HPV16, 18, 31, 33, 45, 52 and 58 are administered. In one embodiment, no E7 antigenic polypeptides from HPV31, 33, 45, 52 and 58 are administered.

An antigenic HPV polypeptide from a specific Early protein, from a specific HPV type, as utilized in the present invention, may include two non-contiguous amino acid sequences from that Early protein, linked either directly or via a short (e.g., ten or fewer amino acids) peptide linker (see, e.g., SEQ ID NOs: 53-55 (E2 antigenic peptide constructs from HPV16, 18 and 51); SEQ ID NOs: 61-62 (E7 antigenic constructs from HPV16 and 18)). Additionally, an antigenic HPV polypeptide may contain one, two, three, or more amino acid substitutions (compared to the wild-type sequence), e.g., to eliminate or alter the activity of the expressed polypeptides. In one embodiment, an antigenic HPV polypeptide contains a single amino acid substitution. In another embodiment, an antigenic HPV polypeptide contains two amino acid substitutions.

Antigenic HPV polypeptides utilized in the present methods are preferably selected to contain at least one CD8 or CD4 T-cell epitope. Epitopes may be those identified theoretically or empirically.

In one aspect of the present invention, the transgene of the vector encodes at least one antigenic peptide from the E2 and E6 proteins of at least two high-risk HPV types. In one embodiment, the transgene of the vector encodes at least one antigenic peptide from each of HPV16 E2 and E6, and at least one antigenic peptide from each of HPV18 E2 and E6. In a further embodiment, the transgene additionally encodes at least one antigenic HPV peptide from E1 and/or E7 of HPV16 and/or HPV18. In a further embodiment, the transgene of the vector additionally encodes at least one antigenic peptide from the E2 and E6 proteins of an additional hrHPV type (e.g., HPV31, 33, 35, 39, 45, 51, 52, 56, 58, 59, 68, 73, or 82).

In another aspect of the present invention, the transgene of the vector encodes at least one antigenic peptide from the E2 and E6 proteins of at least two high-risk HPV types. In one embodiment, the transgene encodes at least one antigenic peptide from each of HPV16 E2 and E6 proteins, and at least one antigenic peptide from each of HPV18 E2 and E6 proteins; in a further embodiment, the transgene additionally encodes at least one antigenic HPV peptide from the E2 protein and/or at least one antigenic HPV peptide from the E6 protein, of another hrHPV type (e.g., HPV31, 33, 35, 39, 45, 51, 52, 56, 58, 59, 68, 73, or 82).

In another aspect of the present invention, the transgene of the vector encodes at least one antigenic peptide from the E1 and E7 proteins of at least two high-risk HPV types. In one embodiment, the transgene encodes at least one antigenic peptide from each of HPV16 E1 and E7 proteins, and at least one antigenic peptide from each of HPV18 E1 and E7 proteins; in a further embodiment, the transgene additionally encodes at least one antigenic HPV peptide from the E1 protein, and/or at least one antigenic HPV peptide from the E7 protein, of another hrHPV type (e.g., HPV31, 33, 35, 39, 45, 51, 52, 56, 58, 59, 68, 73, or 82).

In another aspect of the present invention, the transgene of the vector encodes at least one antigenic peptide from the E1 and E2 proteins of at least two high-risk HPV types. In one embodiment, the transgene encodes at least one antigenic peptide from each of HPV16 E1 and E2 proteins, and at least one antigenic peptide from each of HPV18 E1 and E2 proteins; in a further embodiment, the transgene additionally encodes at least one antigenic HPV peptide from the E1 protein, and/or at least one antigenic HPV peptide from the E2 protein, of another hrHPV type (e.g., HPV31, 33, 35, 39, 45, 51, 52, 56, 58, 59, 68, 73, or 82).

In another aspect of the present invention, the transgene of the vector encodes at least one antigenic peptide from the E1 and E6 proteins of at least two high-risk HPV types. In one embodiment, the transgene encodes at least one antigenic peptide from each of HPV16 E1 and E6 proteins, and at least one antigenic peptide from each of HPV18 E1 and E6 proteins; in a further embodiment, the transgene additionally encodes at least one antigenic HPV peptide from the E1 protein, and/or at least one antigenic HPV peptide from the E6 protein, of another hrHPV type (e.g., HPV31, 33, 35, 39, 45, 51, 52, 56, 58, 59, 68, 73, or 82).

In another aspect of the present invention, the transgene of the vector encodes at least one antigenic peptide from the E2 and E7 proteins of at least two high-risk HPV types. In one embodiment, the transgene encodes at least one antigenic peptide from each of HPV16 E2 and E7 proteins, and at least one antigenic peptide from each of HPV18 E2 and E7 proteins; in a further embodiment, the transgene additionally encodes at least one antigenic HPV peptide from the E2 protein, and/or at least one antigenic HPV peptide from the E7 protein, of another hrHPV type (e.g., HPV31, 33, 35, 39, 45, 51, 52, 56, 58, 59, 68, 73, or 82).

In another aspect of the present invention, the transgene of the vector encodes at least one antigenic peptide from the E6 and E7 proteins of at least two high-risk HPV types. In one embodiment, the transgene encodes at least one antigenic peptide from each of HPV16 E6 and E7 proteins, and at least one antigenic peptide from each of HPV18 E6 and E7 proteins; in a further embodiment, the transgene additionally encodes at least one antigenic HPV peptide from the E6 protein, and/or at least one antigenic HPV peptide from the E7 protein, of another hrHPV type (e.g., HPV31, 33, 35, 39, 45, 51, 52, 56, 58, 59, 68, 73, or 82).

In another aspect of the present invention, the transgene of the vector encodes at least one antigenic peptide from any three of the E1, E2, E6 and E7 proteins of at least two high-risk HPV types. In one embodiment, the transgene encodes at least one antigenic peptide from any three of HPV16 E1, E2, E6 and E7 proteins, and at least one antigenic peptide from each of HPV18 E1, E2, E6 and E7 proteins; in a further embodiment, the transgene additionally encodes at least one antigenic HPV peptide from the E1, E2, E6 or E7 proteins of another hrHPV type (e.g., HPV31, 33, 35, 39, 45, 51, 52, 56, 58, 59, 68, 73, or 82).

In one embodiment the transgene of the vector encodes E1 antigenic peptide(s) comprising or consisting of one or more sequences selected from amino acids 14-90, aa203-622, aa211-622 (amino acid numbering corresponds to HPV16 E1, SEQ ID NO:39). The E1 fragment may comprise a Glycine to Aspartic acid substitution at amino acid residue 482 (G482D; numbering corresponds to SEQ ID NO:39). Where two E1 polypeptide sequences are used that are non-contiguous in the naturally occurring protein ('non-contiguous fragments'), they may be joined directly, joined via a peptide or non-peptide linker, or the transgene may be constructed so that the E1 fragments are expressed as separate peptides.

In one embodiment, the transgene of the vector encodes E2 antigenic peptide(s) comprising or consisting of one or more sequences selected from amino acids 1-138, aa1-201, aa150-210, aa260-365, and aa285-365 (amino acid numbering corresponds to HPV16 E2, SEQ ID NO:40). Where the transgene encodes an E2 antigenic peptide comprising the TAD, and an E2 antigenic peptide comprising the DBD, a peptide or non-peptide linker may be placed between the TAD and DBD peptides (e.g., a peptide linker consisting of GGTGGS, SEQ ID NO:95). The E2 antigenic peptide may contain a Lysine to Alanine substitution at amino acid residue 111 (K111A, numbering corresponds to HPV16E2, SEQ ID NO:40). Where non-contiguous E2 fragments are used, they may be joined directly, joined via a peptide or non-peptide linker, or the transgene may be constructed so that the E2 fragments are expressed as separate peptides.

In one embodiment, the transgene of the vector encodes E6 antigenic peptide(s) comprising or consisting of a sequence selected from amino acids 8-147 and aa11-150 (numbering corresponds to HPV16 E6, SEQ ID NO:41). The E6 antigenic peptide may contain a phenylalanine to arginine substitution at amino acid residue 54 (F54R) and/or a cysteine to arginine substitution at amino acid residue 110 (C110R); numbering corresponds to to HPV16 E6, SEQ ID NO:41.

In one embodiment, the transgene of the vector encodes E7 antigenic peptide(s) comprising or consisting of one or more sequences selected from amino acids 49-98 and aa7-28 (amino acid numbering corresponds to HPV16 E7, SEQ ID NO:42). When the transgene contains a fragment comprising aa49-98 and a fragment comprising aa7-28 of E7, fragment aa49-98 may be placed N-terminal to aa7-28. The E7 antigenic peptide may contain a cysteine to glycine substitution at amino acid residue 24 (C24G), and/or a glutamic acid to glutamine substitution at residue 26 (E26Q); numbering corresponds to HPV16 E7, SEQ ID NO:42.

In one embodiment, the transgene comprises nucleotide sequence(s) encoding one or more HPV E1 sequences that are at least 90%, 92%, 95%, 97%, 98%, 99% or 100% identical to a sequence selected from SEQ ID NO:51, SEQ ID NO:52, SEQ ID NO:68, SEQ ID NO:69, SEQ ID NO:70, SEQ ID NO:89, SEQ ID NO:90, SEQ ID NO:98, SEQ ID NO:104, SEQ ID NO:105, SEQ ID NO:106, SEQ ID NO:107 and SEQ ID NO:108. In one embodiment the transgene comprises nucleotide sequence(s) encoding one or more HPV E2 sequences that are at least 90%, 92%, 95%, 97%, 98%, 99% or 100% identical to a sequence selected from SEQ ID NO:53, SEQ ID NO:54, SEQ ID NO:55, SEQ ID NO:71, SEQ ID NO:72, SEQ ID NO:73, SEQ ID NO:74, SEQ ID NO:75, SEQ ID NO:76, SEQ ID NO:77, SEQ ID NO:100, SEQ ID NO:101, SEQ ID NO:102, SEQ ID NO:103, SEQ ID NO:109, SEQ ID NO:110, SEQ ID NO:111, SEQ ID NO:112 and SEQ ID NO:113. In one embodiment the transgene comprises nucleotide sequence(s) encoding one or more HPV E6 sequences that are at least 90%, 92%, 95%, 97%, 98%, 99% or 100% identical to a sequence selected from SEQ ID NO:56, SEQ ID NO:57 SEQ ID NO:58, SEQ ID NO:59, SEQ ID NO:60, SEQ ID NO:78, SEQ ID NO:79, SEQ ID NO:80, SEQ ID NO:81, SEQ ID NO:82, SEQ ID NO:83, SEQ ID NO:84 and SEQ ID NO:99. In one embodiment the transgene comprises nucleotide sequence(s) encoding one or more HPV E7 sequences that are at least 90%, 92%, 95%, 97%, 98%, 99% or 100% identical to a sequence selected from SEQ ID NO:61 and SEQ ID NO:62.

Any of the encoded HPV antigenic fragments may additionally comprise an initial methionine residue where required.

In the transgene constructs of the present invention, the nucleic acid sequences coding for HPV antigenic peptides may be separated by a peptide or non-peptide linker, or a sequence such as a ribosomal skipping sequence that interrupts translation of the transgene and results in expression of multiple peptides.

In one embodiment of the present invention, the transgene comprises or consists of a nucleotide sequence encoding an amino acid sequence that is at least 90%, 92%, 95%, 97%, 98%, 99% or 100% identical to a sequence selected from SEQ ID NO:63, SEQ ID NO:64, SEQ ID NO:65, SEQ ID NO:66, SEQ ID NO:67, SEQ ID NO:85, SEQ ID NO:86, SEQ ID NO:87, SEQ ID NO:88, SEQ ID NO:91, SEQ ID NO:92, SEQ ID NO:93, SEQ ID NO:94, SEQ ID NO:132, SEQ ID NO:133, SEQ ID NO:134, SEQ ID NO:135, SEQ ID NO:136, SEQ ID NO:143, SEQ ID NO:145 and SEQ ID NO:147.

In one embodiment of the present invention, the transgene comprises or consists of a nucleotide sequence which is at least 90%, 92%, 95%, 97%, 98%, 99% or 100% identical to a sequence selected from the group consisting of SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:137, SEQ ID NO:138, SEQ ID NO:139, SEQ ID NO:140, SEQ ID NO:141, SEQ ID NO:144, SEQ ID NO:146 and SEQ ID NO:148.

In one embodiment of the present invention, the transgene does not comprise a nucleotide sequence encoding an antigenic fragment of an HPV Late protein. In another embodiment, the transgene does not comprise a nucleotide sequence encoding an antigenic fragment of an Early protein from a non-high risk HPV type.

Accordingly, in one embodiment, a transgene comprising nucleic acid sequences encoding HPV E1, E2, E6 and/or E7 antigenic peptides, from multiple hrHPV types, is incorporated into a viral vector, such as an adenoviral vector, such as a nonhuman simian adenoviral vector. In one embodiment, the simian adenoviral vector is selected from a chimpanzee adenovirus such as ChAd3, ChAd63, ChAd83, ChAd155, Pan 5, Pan 6, Pan 7 (also referred to as C7) or Pan 9. Examples of such strains are described in WO03/000283, WO2010/086189 and GB1510357.5 and are also available from the American Type Culture Collection, 10801 University Boulevard, Manassas, Va. 20110-2209, and other sources. Alternatively, adenoviral vectors may be derived from nonhuman simian adenoviruses isolated from bonobos, such as PanAd1, PanAd2 or PanAd3. Examples of such vectors described herein can be found for example in WO2005/071093 and WO2010/086189. Adenoviral vectors may also be derived from adenoviruses isolated from gorillas as described in WO2013/52799, WO2013/52811 and WO2013/52832. In one embodiment, the ChAd155 backbones as described herein are utilized.

The expression cassette may be inserted into the viral vector in an existing viral gene region to disrupt the function of that region, if desired. Alternatively, the expression cassette may be inserted into the site of a partially or fully deleted adenoviral gene. For example, for an adenoviral vector, the expression cassette may be located in the site of a mutation, insertion or deletion which renders non-functional at least one gene of a genomic region selected from the group consisting of E1A, E1B, E2A, E2B, E3 and E4. The term "renders non-functional" means that a sufficient amount of the gene region is removed or otherwise disrupted, so that the gene region is no longer capable of producing functional products of gene expression. If desired, the entire gene region may be removed (and suitably replaced with the expression cassette). Suitably, E1 genes of adenovirus are deleted and replaced with an expression cassette consisting of the promoter of choice, cDNA sequence of interest and a poly A signal, resulting in a replication defective recombinant virus.

The sequences of the invention may be produced by any suitable means, including recombinant production, chemical synthesis, or other synthetic means. Suitable production techniques are well known to those of skill in the art. Alternatively, peptides can also be synthesized by well known solid phase peptide synthesis methods.

Regulatory Elements

In addition to the transgene the vector also includes conventional control elements which are operably linked to the transgene in a manner that permits its transcription, translation and/or expression in a cell transfected with the plasmid vector or infected with the virus produced by the invention. As used herein, "operably linked" sequences include both expression control sequences that are contiguous with the gene of interest and expression control sequences that act in trans or at a distance to control the gene of interest.

Expression control sequences include appropriate transcription initiation, termination, promoter and enhancer sequences; efficient RNA processing signals such as splicing and polyadenylation (poly A) signals including rabbit beta-globin polyA; sequences that stabilize cytoplasmic mRNA; sequences that enhance translation efficiency (e.g., Kozak consensus sequence); sequences that enhance protein stability; and when desired, sequences that enhance secretion of the encoded product. Among other sequences, chimeric introns may be used.

In some embodiments, the Woodchuck Hepatitis Virus Posttranscriptional Regulatory Element (WPRE) (Zuffrey et al. (1999)) may be operably linked to the transgene. An exemplary WPRE is provided in SEQ ID NO: 26.

A "promoter" is a nucleotide sequence that permits binding of RNA polymerase and directs the transcription of a gene. Typically, a promoter is located in the 5' non-coding region of a gene, proximal to the transcriptional start site of the gene. Sequence elements within promoters that function in the initiation of transcription are often characterized by consensus nucleotide sequences. Examples of promoters include, but are not limited to, promoters from bacteria, yeast, plants, viruses, and mammals (including humans). A great number of expression control sequences, including promoters which are internal, native, constitutive, inducible and/or tissue-specific, are known in the art and may be utilized.

Examples of constitutive promoters include, without limitation, the Thyroxine Binding Globulin (TBG) promoter, the retroviral Rous sarcoma virus long terminal repeat (LTR) promoter (optionally with the enhancer), the cytomegalovirus (CMV) promoter (optionally with the CMV enhancer, see, e.g., Boshart et al. (1985)), the synthetic 'CAST' promoter, the Simian Vacuolating virus 40 (SV40) promoter, the dihydrofolate reductase promoter, the β-actin promoter, the phosphoglycerol kinase (PGK) promoter, and the EF1a promoter (Invitrogen).

In some embodiments, the promoter is a CASI promoter (see, for example, PCT Patent publication WO2012/115980). The CASI promoter is a synthetic promoter which contains a portion of the CMV enhancer, a portion of the chicken beta-actin promoter, and a portion of the UBC enhancer. In some embodiments, the CASI promoter can include a nucleic acid sequence having at least about 90%, at least about 95%, at least about 96%, at least about 97%, at least about 98%, at least about 99%, or more, sequence identity to SEQ ID NO: 12. In some embodiments, the promoter comprises or consists of a nucleic acid sequence of SEQ ID NO: 12.

Inducible promoters allow regulation of gene expression and can be regulated by exogenously supplied compounds, environmental factors such as temperature, or the presence of a specific physiological state, e.g., acute phase, a particular differentiation state of the cell, or in replicating cells only. Inducible promoters and inducible systems are available from a variety of commercial sources, including, without limitation, Invitrogen, Clontech and Ariad. Many other systems have been described and can be readily selected by one of skill in the art. For example, inducible promoters include the zinc-inducible sheep metallothionine (MT) promoter and the dexamethasone (Dex)-inducible mouse mammary tumor virus (MMTV) promoter. Other inducible systems include the T7 polymerase promoter system (WO 98/10088); the ecdysone insect promoter (No et al, (1996)), the tetracycline-repressible system (Gossen et al, (1992)), the tetracycline-inducible system (Gossen et al, (1995), see also Harvey et al, (1998)). Other systems include the FK506 dimer, VP16 or p65 using castradiol, diphenol murislerone, the RU486-inducible system (Wang et al, (1997a) and Wang et al, (1997b)) and the rapamycin-inducible system (Magari et al., (1997)). The effectiveness of some inducible promoters increases over time. In such cases one can enhance the effectiveness of such systems by inserting multiple repressors in tandem, e.g., TetR linked to a TetR by an IRES.

In another embodiment, a native HPV promoter may be used for the transgene. A native promoter may be preferred when it is desired that expression of the transgene should mimic the native expression. The native promoter may be used when expression of the transgene must be regulated temporally or developmentally, or in a tissue-specific manner, or in response to specific transcriptional stimuli. In a further embodiment, other native expression control elements, such as enhancer elements, polyadenylation sites or Kozak consensus sequences may also be used to mimic the native expression.

Vectors carrying transgenes encoding therapeutically useful immunogenic products may also include selectable markers or reporter genes which may include sequences encoding geneticin, hygromicin or purimycin resistance, among others. Such selectable reporters or marker genes (preferably located outside the viral genome to be packaged into a viral particle) can be used to signal the presence of the plasmids in bacterial cells, such as ampicillin resistance gene. Other components of the vector may include an origin of replication.

In one embodiment, the transgene is designed to express multiple separate polypeptides. Various approaches to designing multicistronic vectors have been described, including using internal ribosomal entry sites (IRES) or other promoters. A further approach is the use of viral 2A, or '2A-like' sequences, which results in production of multiple separate polypeptides. The 2A peptide consensus motif is Asp-Val/Ile-Glu-X-Asn-Pro-Gly-Pro (SEQ ID NO:96), and causes discontinuity between the Gly and Pro residues via a ribosomal skip mechanism. 2A sequences are known from various viruses, including foot-and-mouth disease virus, equinie rhinitis A virus, *Thosea asigna* virus, and porcine theschovirus-1. See e.g., Szymczak et al.

These vectors are generated using the techniques and sequences provided herein, in conjunction with techniques known to those of skill in the art. Such techniques include conventional cloning techniques of cDNA such as those described in texts, use of overlapping oligonucleotide sequences of the adenovirus genomes, polymerase chain reaction, and any suitable method which provides the desired nucleotide sequence.

Therapeutic Adenoviral Vaccine Constructs

Because of the diversity of HPV types that can establish infection and result in LSIL/CIN1 in humans, the adenoviral vector based vaccine constructs of the present invention are designed express antigenic Early HPV proteins and/or peptides that induce or boost CD8+ T cells that are reactive to multiple HPV types. Suitably, the antigenic HPV polypeptides also induce a CD4+ T-cell response. The antigenic proteins are selected to induce an immune reaction to specific HPV types; the targeted HPV types are selected based on HPV protein expression patterns and the prevalence of HPV types in human infection, LSIL and CIN1. Accordingly, the vaccine constructs of the present invention are useful in treating a range of HPV-related disease, including persistent HPV infection, LSIL and/or CIN1.

Thus, the present invention provides a recombinant viral vector, such as a ChAd155-derived adenoviral vector, comprising an expression cassette comprising a transgene capable of expressing immunogenic peptide(s) derived from HPV proteins. Suitable transgenes are described herein.

In one embodiment, the recombinant viral vectors of the present invention are designed for use in a therapeutic vaccination program as described herein (see Methods of Use) to treat e.g., HPV infection, LSIL, and/or CIN1, in a human subject in need of treatment thereof. In one embodiment, the recombinant recombinant viral vector comprises a transgene expressing antigenic peptide fragments from hrHPV early proteins, selected from certain high-risk HPV types, where the peptides are selected or designed to provide cross-reactivity to additional high-risk HPV types.

In one embodiment, the recombinant viral vector of the present invention comprises a transgene encoding antigenic peptide(s) of HPV E1, E2, E6 and/or E7 polypeptides from hrHPV types. In another embodiment of the present invention, the nucleotide sequence is capable of expressing HPV E2 and E6 antigenic peptides from hrHPV types; in another embodiment, the nucleotide sequence is capable of expressing E1 and E7 antigenic peptides from hrHPV types. In another embodiment, the nucleotide sequence is capable of expressing antigenic peptides from any two, three or four of HPV E1, E2, E6, and E7 proteins, where the proteins are from hrHPV types.

More specifically, in one embodiment the present invention provides a recombinant viral vector comprising an expression cassette comprising an immunogenic transgene comprising any of (a) a nucleotide sequence encoding three E2 antigenic polypeptides (from HPV 16, 18, and 51), five E6 antigenic polypeptides (from HPV 16, 18, 58, 56, 73), two E1 antigenic polypeptides (from HPV 16 and 18), and two E7 antigenic polypeptides (from HPV 16 and 18), (b) a nucleotide sequence encoding three E2 antigenic polypeptides (from HPV 16, 18, and 51), five E6 antigenic polypeptides (from HPV 16, 18, 58, 56, 73), (c) a nucleotide sequence encoding two E1 antigenic polypeptides (from HPV 16 and 18) and two E7 antigenic polypeptides (from HPV 16 and 18) (d) a nucleotide sequence encoding three E1 antigenic polypeptides (from HPV16, 18, and 33), two E7 antigenic polypeptides (from HPV16 and 18), and three E2 antigenic polypeptides (from HPV45, 52 and 58); (e) a nucleotide sequence encoding four E2 antigenic polypeptides (from HPV16, 18, 31, and 33), and seven E6 antigenic polypeptides (from HPV16, 18, 31, 33, 45, 52, and 58); (f) a nucleotide sequence encoding five E1 antigenic polypeptides (from HPV16, 18, 31, 33, and 45), and two E7 antigenic polypeptides (from HPV16 and 18); (g) a nucleotide sequence encoding five E2 antigenic polypeptides (from HPV16, 18, 33, 52 and 58) and six E6 antigenic polypeptides (from HPV16, 18, 31, 45, 52 and 58). The transgene may further comprise a peptide or non-peptide linker located between adjacent HPV sequences, or a sequence that induces separate translation of the adjacent HPV sequences (such as the 2A ribosomal skipping sequence described herein).

Methods of Use

The adenoviral vectors of the present invention are useful as therapeutic vaccines, to treat persistant HPV infection or subclinical HPV infection of the human anogenital epithelium, such as cervical epithelium, or HPV-related conditions such as CIN1 or LSIL, in a subject in need of such treatment. Suitable subjects include humans.

In treating human subjects, a ChAd155-derived recombinant adenoviral vector provides an efficient delivery vehicle that can deliver a selected transgene to a selected host cell in vivo even where the subject has neutralizing antibodies to one or more human adenovirus serotypes. In one embodiment, the vector and the cells are mixed ex vivo; the infected cells are cultured using conventional methodologies; and the transduced cells are re-introduced into the patient. These techniques are suited to transgene delivery for therapeutic purposes and for immunization. Because the capacity of the transgene is limited, it will be apparent to those skilled in the art that an effective treatment may require administration of more than one vector construct, in order to administer the range of HPV antigenic polypeptides required to achieve a therapeutic effect.

The recombinant vectors comprising HPV transgenes may be administered in immunogenic compositions. An immunogenic composition as described herein is a composition comprising one or more recombinant vectors capable of inducing an immune response, for example a humoral (e.g., antibody) and/or cell-mediated (e.g., a cytotoxic T cell) response, against a transgene product delivered by the vector following delivery to a mammal, suitably a human. Recombinant vectors comprising transgenes encoding selected hrHPV antigenic peptide(s), as described herein, are therefore suitable for use in a therapeutic vaccine to treat HPV infection or HPV-related disease.

Accordingly, in one embodiment the present invention provides a recombinant adenovirus, such as a ChAd155-derived adenoviral vector as described herein, for use in the treatment HPV infection or HPV-related disease, including HPV-related lesions staged or diagnosed as CIN1 or LSIL. Such recombinant ChAd155-derived adenoviral vectors suitably comprise an expression cassette comprising a transgene encoding immunogenic peptides derived from hrHPV, as described herein.

In further embodiments, the present invention provides the use of a recombinant adenovirus according to the present invention in the manufacture of a medicament for the generation of an immune response against HPV. Thus, the present invention provides the use of a recombinant ChAd155-derived adenoviral vector comprising an expression cassette comprising a transgene encoding immunogenic peptides derived from hrHPV, as described herein, in the manufacture of a medicament for the treatment of HPV infection or associated disease.

In one embodiment, the present invention provides a method of treating infection or disease caused by HPV, comprising the administration of an effective amount of a ChAd155-derived adenovirus vector comprising an expression cassette comprising a transgene encoding immunogenic peptides derived from hrHPV, as described herein. In one embodiment, the present invention provides a method of generating or enhancing an immune response directed against HPV, comprising the administration of a recombinant adenovirus according to the present invention. Particularly, the method of generating or enhancing an immune response comprises the administration of an effective amount of a ChAd155-derived adenovirus comprising a transgene encoding at least two antigenic HPV polypeptides from a first HPV early protein, such as E2, where the antigenic HPV polypeptides are from different high-risk HPV types (e.g., an antigenic polypeptide from HPV16 E2 and an antigenic polypeptide from HPV18 E2), and where the antigenic polypeptides share at least 70% amino acid sequence identity with an additional high-risk HPV type (where the transgene does not encode antigenic polypeptides from that additional high-risk HPV type).

The transgene typically further encodes at least two antigenic HPV polypeptides from a second HPV early protein, such as E6, where the antigenic HPV polypeptides are from different high-risk HPV types (e.g., an antigenic polypeptide from HPV16 E6 and an antigenic polypeptide from HPV18 E6), and where the antigenic polypeptides share at least 70% amino acid sequence identity with an additional high-risk HPV type (e.g., HPV35), though the transgene does not encode antigenic polypeptides from that additional high-risk HPV type. Additionally, the antigenic polypeptides may be selected to include at least one T cell epitope.

In one embodiment, the present invention provides an immunogenic composition comprising a recombinant ChAd155-derived adenovirus of the present invention, including an expression cassette comprising a transgene encoding immunogenic peptides derived from hrHPV, as described herein, and a pharmaceutically acceptable excipient. In one embodiment, the immunogenic composition is a vaccine.

Such vaccines or other immunogenic compositions may be formulated in a suitable delivery vehicle. Generally, doses for the immunogenic compositions are in the range defined below under 'Delivery Methods and Dosage'. The levels of immunity (humoral and/or cell based) to the selected peptide(s) can be monitored to determine the need, if any, for subsequent (booster) immunizations. Following an assessment of antibody titers in the serum, optional booster immunizations may be administered.

The vaccines and immunogenic compositions of the invention may be formulated to contain other components, including, e.g., adjuvants, stabilizers, pH adjusters, preservatives and the like. Examples of suitable adjuvants are provided herein. Such an adjuvant can be administered with a priming DNA vaccine encoding an antigen to enhance the antigen-specific immune response compared with the immune response generated upon priming with a DNA vaccine encoding the antigen only. Alternatively, such an adjuvant can be administered with a polypeptide antigen as part of an overall administration regimen using the ChAd155 vectors of the invention (as described herein).

The recombinant adenoviruses are administered in an immunogenic amount, that is, an amount of recombinant adenovirus that is effective in a route of administration to transfect the desired target cells and provide sufficient levels of expression of the selected polynucleotide sequences to induce an effective immune response. As used herein, an effective immune response is one resulting in a therapeutic effect.

The recombinant vectors described herein are expected to be efficacious at inducing cytolytic T cells directed to the HPV antigenic protein(s) expressed by the vector.

It will be apparent to one skilled in the art that the use of certain sequences in the transgene, between the HPV sequences, will result in the addition of amino acids to the HPV antigenic sequence. Use of the '2A' sequence as described herein between (in 5' to 3' direction) a nucleotide sequence encoding a first HPV peptide and a nucleotide sequence encoding a second HPV peptide results in the addition of amino acids 1-23 of SEQ ID NO:47 to the first expressed HPV peptide, and addition of a Proline residue to the second expressed HPV peptide.

Adjuvants

An "adjuvant" as used herein refers to a composition that enhances the immune response to an antigen, such as to an HPV peptide in a human subject. Examples of such adjuvants include but are not limited to inorganic adjuvants (e.g. inorganic metal salts such as aluminium phosphate or aluminium hydroxide), organic adjuvants (e.g. saponins, such as QS21, or squalene), oil-based adjuvants (e.g. Freund's complete adjuvant and Freund's incomplete adjuvant), cytokines (e.g. IL-1β, IL-2, IL-7, IL-12, IL-18, GM-CFS, and INF-γ) particulate adjuvants (e.g. immuno-stimulatory complexes (ISCOMS), liposomes, or biodegradable microspheres), virosomes, bacterial adjuvants (e.g. monophosphoryl lipid A, such as 3-de-O-acylated monophosphoryl lipid A (3D-MPL), or muramyl peptides), synthetic adjuvants (e.g. non-ionic block copolymers, muramyl peptide analogues, or synthetic lipid A), synthetic polynucleotides adjuvants (e.g polyarginine or polylysine) and immunostimulatory oligonucleotides containing unmethylated CpG dinucleotides ("CpG"). Toll-like receptor-7 dependent (TLR7) agonists, such as small molecule immune potentiators (SMIPs) may also be used as adjuvants, and may be designed to be adsorbed to an inorganic component such as aluminum hydroxide. see e.g., Wu et al., Rational design of small molecules as vaccine adjuvants. Sci Transl Med 6(263ra160) (2014).

One suitable adjuvant is monophosphoryl lipid A (MPL), in particular 3-de-O-acylated monophosphoryl lipid A (3D-MPL). Chemically it is often supplied as a mixture of 3-de-O-acylated monophosphoryl lipid A with either 4, 5, or 6 acylated chains. It can be purified and prepared by the methods taught in GB 2122204B, which reference also discloses the preparation of diphosphoryl lipid A, and 3-O-deacylated variants thereof. Other purified and synthetic lipopolysaccharides have been described (U.S. Pat. No. 6,005,099 and EP patent publication EP 0 729 473 B1; Hilgers et al., (1986); Hilgers et al., (1987); and EP 0 549 074 B1).

Saponins are also suitable adjuvants (see Lacaille-Dubois and Wagner (1996)). For example, the saponin Quil A (derived from the bark of the South American tree Quillaja Saponaria Molina), and fractions thereof, are described in U.S. Pat. No. 5,057,540 and Kensil, (1996); and EP 0 362 279 B1. Purified fractions of Quil A are also known as immunostimulants, such as QS21 and QS17; methods of their production are disclosed in U.S. Pat. No. 5,057,540 and EP 0 362 279 B1. Also described in these references is QS7 (a non-haemolytic fraction of Quil-A). Use of QS21 is further described in Kensil et al. (1991). Combinations of QS21 and polysorbate or cyclodextrin are also known (WO 99/10008). Particulate adjuvant systems comprising fractions of QuilA, such as QS21 and QS7 are described in WO 96/33739 and WO 96/11711.

Another adjuvant is an immunostimulatory oligonucleotide containing unmethylated CpG dinucleotides ("CpG") (Krieg, (1995)). CpG is an abbreviation for cytosine-guanosine dinucleotide motifs present in DNA. CpG is known as an adjuvant when administered by both systemic and mucosal routes (WO 96/02555, EP 468520, Davis et al, (1998); McCluskie and Davis, (1998)). CpG, when formulated into vaccines, may be administered in free solution together with free antigen (WO 96/02555) or covalently conjugated to an antigen (WO 98/16247), or formulated with a carrier such as aluminium hydroxide (Brazolot-Millan et al., 1998)).

Adjuvants such as those described above may be formulated together with carriers, such as liposomes, oil in water emulsions, and/or metallic salts (including aluminum salts such as aluminum hydroxide). For example, 3D-MPL may be formulated with aluminum hydroxide (EP 0 689 454) or oil in water emulsions (WO 95/17210); QS21 may be formulated with cholesterol containing liposomes (WO 96/33739), oil in water emulsions (WO 95/17210) or alum (WO 98/15287); CpG may be formulated with alum (Brazolot-Millan, et al., (1998)) or with other cationic carriers.

Combinations of adjuvants may be utilized in the present invention, in particular a combination of a monophosphoryl lipid A and a saponin derivative (see, e.g., WO 94/00153; WO 95/17210; WO 96/33739; WO 98/56414; WO 99/12565; WO 99/11241), more particularly the combination of QS21 and 3D-MPL as disclosed in WO 94/00153, or a composition where the QS21 is quenched in cholesterol-containing liposomes (DQ) as disclosed in WO 96/33739. Alternatively, a combination of CpG plus a saponin such as QS21 is an adjuvant suitable for use in the present invention. A potent adjuvant formulation involving QS21, 3D-MPL & tocopherol in an oil in water emulsion is described in WO 95/17210 and is another formulation for use in the present invention. Saponin adjuvants may be formulated in a liposome and combined with an immunostimulatory oligonucleotide. Thus, suitable adjuvant systems include, for example, a combination of monophosphoryl lipid A, preferably 3D-MPL, together with an aluminium salt (e.g. as described in WO00/23105). A further exemplary adjuvant comprises comprises QS21 and/or MPL and/or CpG. QS21 may be quenched in cholesterol-containing liposomes as disclosed in WO 96/33739. AS01 is an Adjuvant System containing MPL and QS21; AS01B is a liposomal Adjuvant System containing 50 ug MPL and 50 ug QS21 per human dose (500 uL). AS04 is an Adjuvant System containing MPL (50 μg MPL) adsorbed on Aluminum salt (500 μg $Al^{3+}$) (such as Al $PO_4$ or $Al(OH)_3$).

Other suitable adjuvants include alkyl Glucosaminide phosphates (AGPs) such as those disclosed in WO9850399 or U.S. Pat. No. 6,303,347 (processes for preparation of AGPs are also disclosed), or pharmaceutically acceptable salts of AGPs as disclosed in U.S. Pat. No. 6,764,840. Some AGPs are TLR4 agonists, and some are TLR4 antagonists.

It has been found (WO 2007/062656, which published as US 2011/0293704 and is incorporated by reference for the purpose of disclosing invariant chain sequences) that the fusion of the invariant chain to an antigen which is comprised by an expression system used for vaccination increases the immune response against said antigen, if it is administered with an adenovirus. Accordingly, in one embodiment of the invention, the immunogenic transgene may be co-expressed with invariant chain in a recombinant vector, such as a nonhuman primate vector, such as a ChAd155 vector.

The capsid of ChAd155 (e.g., as an intact or recombinant viral particle or an empty capsid) may be used to induce an immunomodulatory effect response, or to enhance or adjuvant a cytotoxic T cell response to another active agent. The ChAd155 capsid can be delivered in a combination regimen with an active agent (e.g., a ChAd155-derived viral vector expressing immunogenic HPV peptides) to enhance the immune response thereto.

Administration Regimens

It will be readily understood that the recombinant adenoviral vectors of the invention are suited for use in regimens involving repeated delivery of HPV immunogenic peptide(s) over time for therapeutic purposes. Such regimens may utilize delivery of a series of viral vectors in which the viral capsids are alternated. The viral capsids may be changed for each subsequent administration, or after a pre-selected number of administrations of a particular serotype capsid (e.g. one, two, three, four or more). Thus, a regimen may involve delivery of a recombinant adenovirus with a first capsid, delivery of a recombinant adenovirus with a second capsid, and delivery with a recombinant adenovirus with a third capsid.

The regimens may involve multiple delivery of the same transgene(s) or a delivery over time of different transgenes.

A therapeutic regimen may thus involve administration of an adenoviral vector followed, at a subsequent time, by repeat administration with a ChAd155 vector which has a capsid which differs from the source of the capsid in the first delivered adenoviral vector, and optionally further administration with another vector which is the same or which, preferably, differs from the source of the adenoviral capsid of the vector in the prior administration steps. These regimens may deliver the same or different therapeutic immunogenic HPV peptide(s). These regimens are not limited to delivery of adenoviral vectors constructed using the ChAd155 sequences but can utilize other adenoviral sequences, including, without limitation, from non-human primate adenoviral sequences, or human adenoviral sequences, in combination with the ChAd155 vectors.

Lorin et al. (2015) reported that a heterologous prime-boost regimen combining adjuvanted recombinant protein (HIV F4 protein adjuvanted with AS01B) and simian adenoviral vectors expressing the same HIV antigens, induced balanced polyfunctional CD4+ and CD8+ T-cell responses in various mucosal and systemic compartments in mice.

Accordingly, a prime-boost regimen combining adjuvanted hrHPV antigenic polypeptides and low-seroprevalent simian adenoviral vectors (such as ChAd155) expressing hrHPV antigenic polypeptides is suitable for use in the present invention.

In a further example, a therapeutic regimen may involve either simultaneous (such as co-administration) or sequential (such as a prime-boost) delivery of (i) one or more viral vectors and (ii) a further component such as non-viral vectors, and/or a variety of other therapeutically useful compounds or molecules such as antigenic peptide(s) and/or protein(s), including compositions comprising antigenic peptide(s) and/or proteins and an adjuvant. These regimens may deliver the same or different therapeutic (antigenic) molecules. Examples of co-administration include homolateral co-administration and contra-lateral co-administration (further described herein).

Suitable non-adenoviral vectors for use in simultaneous or particularly in sequential delivery (such as prime-boost) with one or more ChAd155 adenoviral vectors include one or more poxviral vectors. Suitably, the poxviral vector belongs to the subfamily chordopoxvirinae, more suitably to a genus in said subfamily selected from the group consisting of orthopox, parapox, yatapox, avipox (suitably canarypox (ALVAC) or fowlpox (FPV)) and molluscipox. Even more suitably, the poxviral vector belongs to the orthopox and is selected from the group consisting of vaccinia virus, NYVAC (derived from the Copenhagen strain of vaccinia), Modified Vaccinia Ankara (MVA), cowpoxvirus and monkeypox virus. Most suitably, the poxviral vector is MVA.

"Simultaneous" administration refers to administration in a time period such that the simultaneously administered components contribute to the same ongoing immune response, e.g., the components are administered at the same time (e.g., co-formulated into a unitary dose, or admixed just prior to administration to the subject) or delivered in separate formulations in a limited time frame (e.g., a single day, hour, or fraction of an hour). Simultaneous administration is also referred to as co-administration. In some embodiments, co-administration may involve administration of an adenoviral vector and administration of a protein component, which may be an adjuvanted protein composition. In other embodiments, co-administration may involve administration of an adenoviral vector and another viral vector, for example a second adenoviral vector or a poxvirus such as MVA.

A prime-boost regimen may be used in the methods of the present invention. Prime-boost refers to eliciting two separate immune responses in the same individual: (i) an initial priming of the immune system followed by (ii) a secondary or boosting of the immune system weeks or months after the primary immune response has been established.

Such a prime-boost regimen may involve the administration of a recombinant vector to prime the immune system and administration of a second, booster, administration with a traditional antigen, such as a protein (optionally co-administered with adjuvant), or with a recombinant virus carrying the sequences encoding such an antigen (see e.g., WO 00/11140). The protein may be a recombinant protein comprising multiple HPV antigenic sequences. Alternatively, an immunization regimen may involve the administration of a recombinant ChAd155 vector to boost the immune response to a vector (either viral or DNA-based) encoding an antigen. In another alternative, an immunization regimen involves administration of a protein antigen followed by booster with a recombinant ChAd155 vector encoding the antigen.

Preferably, a boosting composition is administered about two to about 27 weeks after administering the priming composition to the subject. The administration of the boosting composition is accomplished using an effective amount of a boosting composition containing or capable of delivering the same antigen or a different antigen as administered by the priming vaccine. The boosting composition may be composed of a recombinant viral vector derived from the same viral source or from another source. Alternatively, the boosting composition can be a composition containing the same antigen as encoded in the priming vaccine, but in the form of a protein, which composition induces an immune response in the host. The primary requirements of the boosting composition are that the antigen of the composition is the same antigen, or a cross-reactive antigen, as that encoded by the priming composition.

Delivery Methods and Dosage

The compositions disclosed herein are for use in a method for inducing a cross-reactive immune response against hrHPVs of at least three different hrHPV types in a mammalian subject, the method comprising administering to a subject in need of treatment an immunologically effective amount of the compositions as provided herein.

The vector of the present invention may be prepared for administration by being suspended or dissolved in a pharmaceutically or physiologically acceptable carrier. A "pharmaceutically acceptable carrier" includes any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, sucrose, trehalose, lactose, and lipid aggregates (such as oil droplets or liposomes). Such carriers are well known to those of ordinary skill in the art. The compositions may also contain a pharmaceutically acceptable diluent, such as water, saline, glycerol, etc. Additionally, auxiliary substances, such as wetting or emulsifying agents, pH buffering substances, and the like, may be present. Sterile pyrogen-free, phosphate-buffered physiologic saline is a typical carrier. The appropriate carrier may depend in large part upon the route of administration.

In some embodiments, a composition comprising the recombinant adenovirus of the invention is administered to a subject by intramuscular injection, intravaginal injection, intravenous injection, intraperitoneal injection, subcutaneous injection, epicutaneous administration, intradermal administration, nasal administration or oral administration.

Because viral vectors may be limited in the size of the transgene that they can effectively carry and express, in one embodiment the therapeutic method of the present invention comprises the administration of two or more viral vectors carrying different transgenes, in order to achieve sufficient expression of multiple HPV antigenic peptides in the subject. For example, one transgene may express antigenic peptides from E1 and E7 proteins of hrHPV types, while a co-administered transgene expresses antigenic peptides from E2 and E6 proteins of hrHPV. Alternatively, the different transgenes may express antigenic peptides from the same HPV Early proteins, but from different hrHPV types.

If the therapeutic regimen involves co-administration of more than one viral vector, the viral vectors may be co-formulated in a single unit dose. Where vectors are formulated in different compositions, they may be administered co-locationally at or near the same site. For example, the components can be administered to a subject (e.g. via an administration route selected from intramuscular, transdermal, intradermal, sub-cutaneous) to the same side or extremity ("co-lateral" administration) or to opposite sides or extremities ("contra-lateral" administration).

Dosages of the viral vector will depend primarily on factors such as the route of administration, the condition being treated, the age, weight and health of the patient, and may thus vary among patients. For example, a therapeutically effective adult human or veterinary dosage of the viral vector generally contains $1 \times 10^5$ to $1 \times 10^{15}$ viral particles, such as from $1 \times 10^8$ to $1 \times 10^{12}$ (e.g., $1 \times 10^8$, $2.5 \times 10^8$, $5 \times 10^8$, $1 \times 10^9$, $1.5 \times 10^9$, $2.5 \times 10^9$, $5 \times 10^9$, $1 \times 10^{10}$, $1.5 \times 10^{10}$, $2.5 \times 10^{10}$, $5 \times 10^{10}$, $1 \times 10^{11}$ $1.5 \times 10^{11}$, $2.5 \times 10^{11}$, $5 \times 10^{11}$, $1 \times 10^{12}$ particles). Alternatively, a viral vector can be administered at a dose that is typically from $1 \times 10^5$ to $1 \times 10^{10}$ plaque forming units (PFU), such as $1 \times 10^5$ PFU, $2.5 \times 10^5$ PFU, $5 \times 10^5$ PFU, $1 \times 10^6$ PFU, $2.5 \times 10^6$ PFU, $5 \times 10^6$ PFU, $1 \times 10^7$ PFU, $2.5 \times 10^7$ PFU, $5 \times 10^7$ PFU, $1 \times 10^8$ PFU, $2.5 \times 10^8$ PFU, $5 \times 10^8$ PFU, $1 \times 10^9$ PFU, $2.5 \times 10^9$ PFU, $5 \times 10^9$ PFU, or $1 \times 10^{10}$ PFU. For example, a suitable human or veterinary dosage (for about an 80 kg animal) for intramuscular injection is in the range of about $1 \times 10^9$ to about $5 \times 10^{12}$ particles per mL, for a single site. Optionally, multiple sites of administration may be used. In another example, a suitable human or veterinary dosage may be in the range of about $1 \times 10^{11}$ to about $1 \times 10^{15}$ particles for an oral formulation.

The viral vector can be quantified by Quantitative PCR Analysis (Q-PCR), for example with primers and probe designed on CMV promoter region using as standard curve serial dilution of plasmid DNA containing the vector genome with expression cassette including HCMV promoter. The copy number in the test sample is determined by the parallel line analysis method. Alternative methods for vector particle quantification can be analytical HPLC or spectrophotometric method based on A260 nm.

An immunologically effective amount of a nucleic acid may suitably be between 1 ng and 100 mg. For example, a suitable amount can be from 1 μg to 100 mg. An appropriate amount of the particular nucleic acid (e.g., vector) can readily be determined by those of skill in the art. Exemplary effective amounts of a nucleic acid component can be between 1 ng and 100 μg, such as between 1 ng and 1 μg (e.g., 100 ng-1 μg), or between 1 μg and 100 μg, such as 10 ng, 50 ng, 100 ng, 150 ng, 200 ng, 250 ng, 500 ng, 750 ng, or 1 μg. Effective amounts of a nucleic acid can also include from 1 μg to 500 μg, such as between 1 μg and 200 μg, such as between 10 and 100 μg, for example 1 μg, 2 μg, 5 μg, 10 μg, 20 μg, 50 μg, 75 μg, 100 μg, 150 μg, or 200 μg. Alternatively, an exemplary effective amount of a nucleic acid can be between 100 μg and 1 mg, such as from 100 μg to 500 μg, for example, 100 μg, 150 μg, 200 μg, 250 μg, 300 μg, 400 μg, 500 μg, 600 μg, 700 μg, 800 μg, 900 μg or 1 mg.

Generally, a human dose will be in a volume of between 0.1 ml and 2 ml. Thus, the composition described herein can be formulated in a volume of, for example, about 0.1, 0.15, 0.2, 0.5, 1.0, 1.5 or 2.0 ml human dose per individual or combined immunogenic components.

One of skill in the art may adjust these doses, depending on the route of administration and the subject being treated.

The therapeutic immune response against the protein encoded by the selected transgene can be monitored to determine the need, if any, for boosters. Following an assessment of the immune response (e.g., of CD8+ T cell response, antibody titers, in the serum, or both), optional booster immunizations may be administered.

The present invention will now be further described by means of the following non-limiting examples.

EXAMPLES

Example 1: Isolation of ChAd155

Wild type chimpanzee adenovirus type 155 (ChAd155) was isolated from a healthy young chimpanzee housed at the New Iberia Research Center facility (New Iberia Research Center; The University of Louisiana at Lafayette) using standard procedures as described in Colloca et al. (2012) and WO 2010086189, which is hereby incorporated by reference for the purpose of describing adenoviral isolation and characterization techniques.

Example 2: ChAd155 Vector Construction

Figure 2:
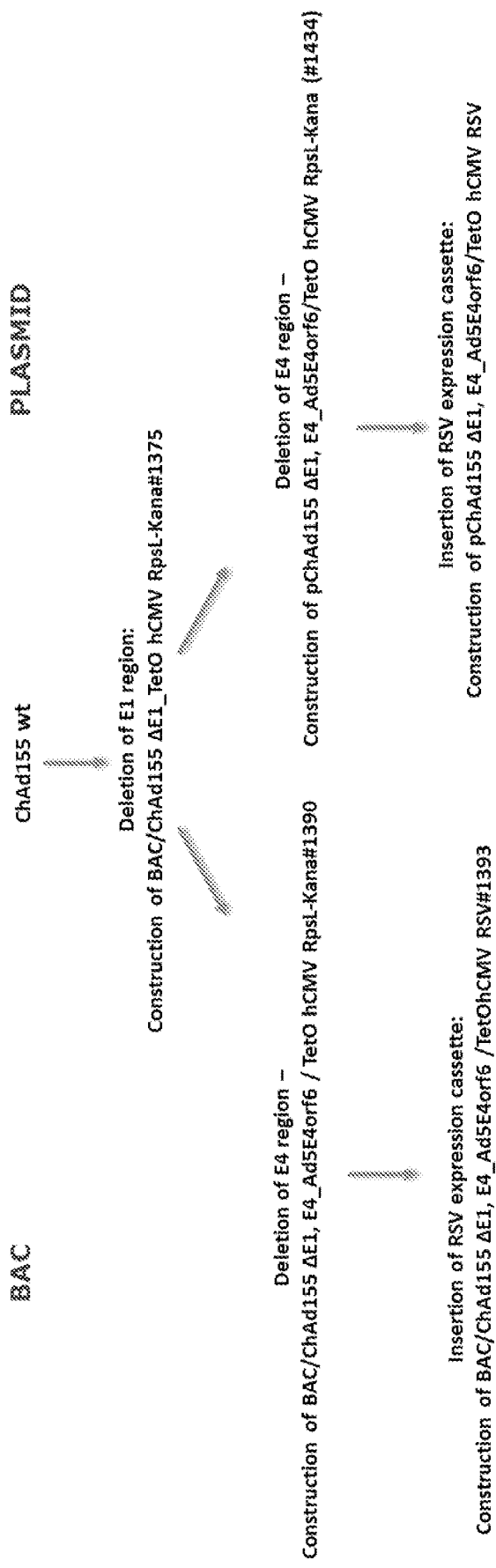
FIG. 2: Flow diagram for production of specific ChAd155 BAC and plasmid vectors.

The ChAd155 viral genome was then cloned in a plasmid or in a BAC vector and subsequently modified (FIG. 2) to carry the following modifications in different regions of the ChAd155 viral genome:
 a) deletion of the ChAd155 E1 region (from bp 449 to bp 3529) of the viral genome,
 b) deletion of the ChAd155 E4 region (from bp 34731 to bp 37449) of the viral genome, and
 c) insertion of the ChAd155E4orf6 derived from human Ad5.

2.1: Deletion of ChAd155E1 Region: Construction of BAC/ChAd155 ΔE1_TetO hCMV RpsL-Kana #1375

Figure 3:
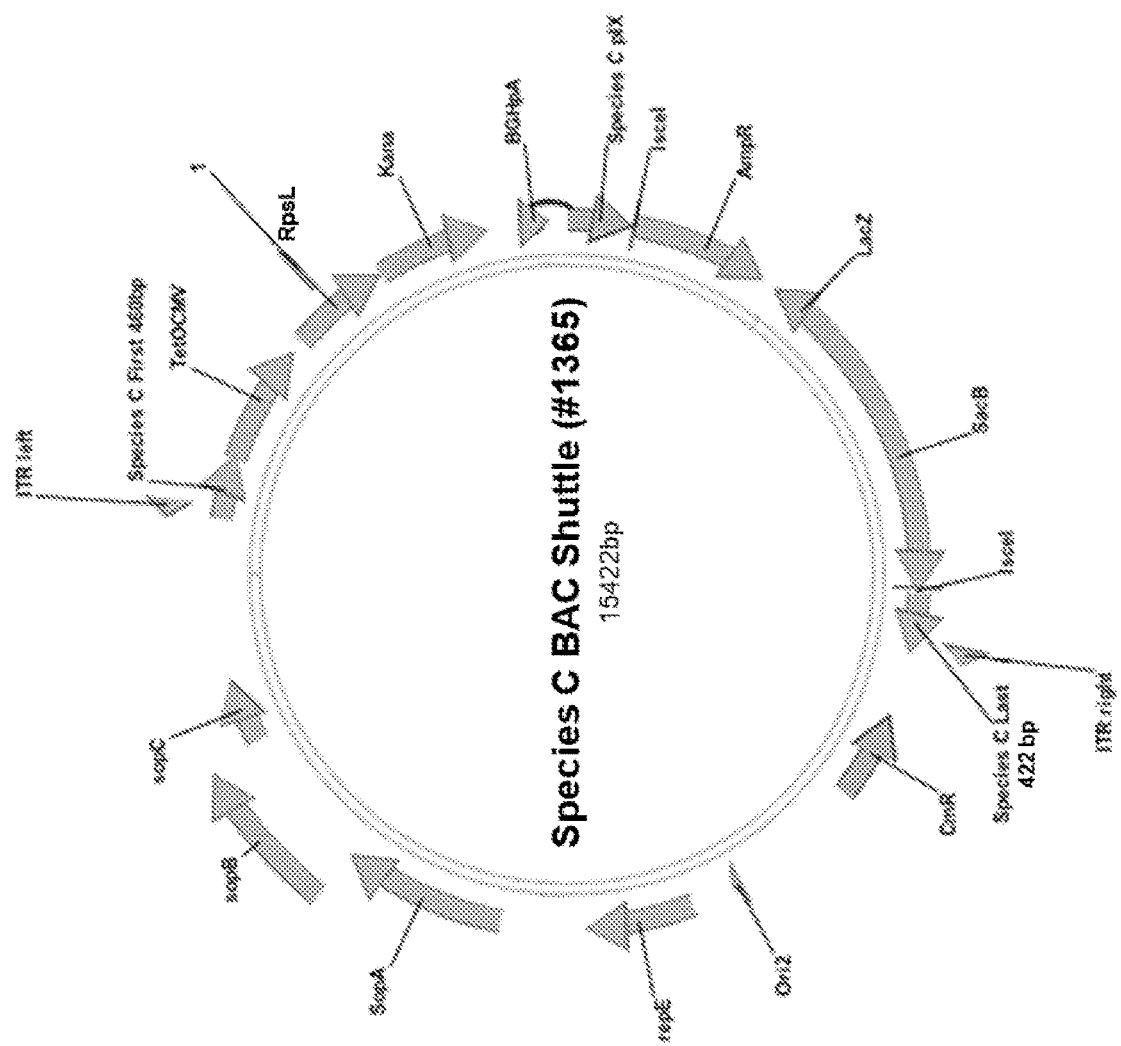
FIG. 3: Species C BAC Shuttle #1365 schematic.

The ChAd155 viral genome was cloned into a BAC vector by homologous recombination in *E. coli* strain BJ5183 electroporation competent cells (Stratagene catalog no. 2000154) co-transformed with ChAd155 viral DNA and Subgroup C BAC Shuttle (#1365). As shown in the schematic of FIG. 3, the Subgroup C Shuttle is a BAC vector derived from pBeloBAC11 (GenBank U51113, NEB) and which is dedicated to the cloning of ChAd belonging to species C and therefore contains the pIX gene and DNA fragments derived from right and left ends (including right and left ITRs) of species C ChAd viruses.

The Species C BAC Shuttle also contains a RpsL-Kana cassette inserted between left end and the pIX gene. In addition, an Amp-LacZ-SacB selection cassette, flanked by IsceI restriction sites, is present between the pIX gene and right end of the viral genome. In particular, the BAC Shuttle comprised the following features: Left ITR: bp 27 to 139, hCMV(tetO) RpsL-Kana cassette: bp 493 to 3396, pIX gene: bp 3508 to 3972, ISceI restriction sites: bp 3990 and 7481, Amp-LacZ-SacB selection cassette: bp 4000 to 7471, Right ITR: bp 7805 to 7917.

BJ5183 cells were co-transformed by electroporation with ChAd155 purified viral DNA and Subgroup C BAC Shuttle vector digested with ISceI restriction enzyme and then purified from gel. Homologous recombination occurring between pIX gene and right ITR sequences (present at the ends of Species C BAC Shuttle linearized DNA) and homologous sequences present in ChAd155 viral DNA lead to the insertion of ChAd155 viral genomic DNA in the BAC shuttle vector. At the same time, the ChAd155 E1 region was deleted and substituted by the RpsL-Kana cassette, generating BAC/ChAd155 ΔE1/TetO hCMV RpsL-Kana #1375.

2.2: Plasmid Construction by Homologous Recombination in *E. coli* BJ5183

2.2.1: Deletion of E4 Region—Construction of pChAd155 ΔE1, ΔE4 Ad5E4Orf6/TetO hCMV RpsL-Kana (#1434)

To improve propagation of the vector, a deletion of the E4 region spanning from nucleotide 34731-37449 (ChAd155 wild type sequence) was introduced in the vector backbone by replacing the native E4 region with Ad5 E4orf6 coding sequence using a strategy involving several steps of cloning and homologous recombination in *E. coli*. The E4 coding region was completely deleted while the E4 native promoter and polyadenylation signal were conserved. To this end, a shuttle vector was constructed to allow the insertion of Ad5orf6 by replacing the ChAd155 native E4 region by homologous recombination in *E. coli* BJ5183 as detailed below.

Construction of pARS SpeciesC Ad5E4Orf6-1

A DNA fragment containing Ad5orf6 was obtained by PCR using Ad5 DNA as template, with the oligonucleotides 5'-ATACGGACTA GTGGAGAAGT ACTCGCCTAC ATG-3' (SEQ ID NO: 13) and 5'-ATACGGAAGA TCTAA-GACTT CAGGAAATAT GACTAC-3' (SEQ ID NO: 14). The PCR fragment was digested with BglII and SpeI and cloned into Species C RLD-EGFP shuttle digested with BglII and SpeI, generating the plasmid pARS Species C Ad5orf6-1. Details regarding the shuttle can be found in Colloca et al, (2012).

Construction of pARS SpeciesC Ad5E4Orf6-2

Figure 4:
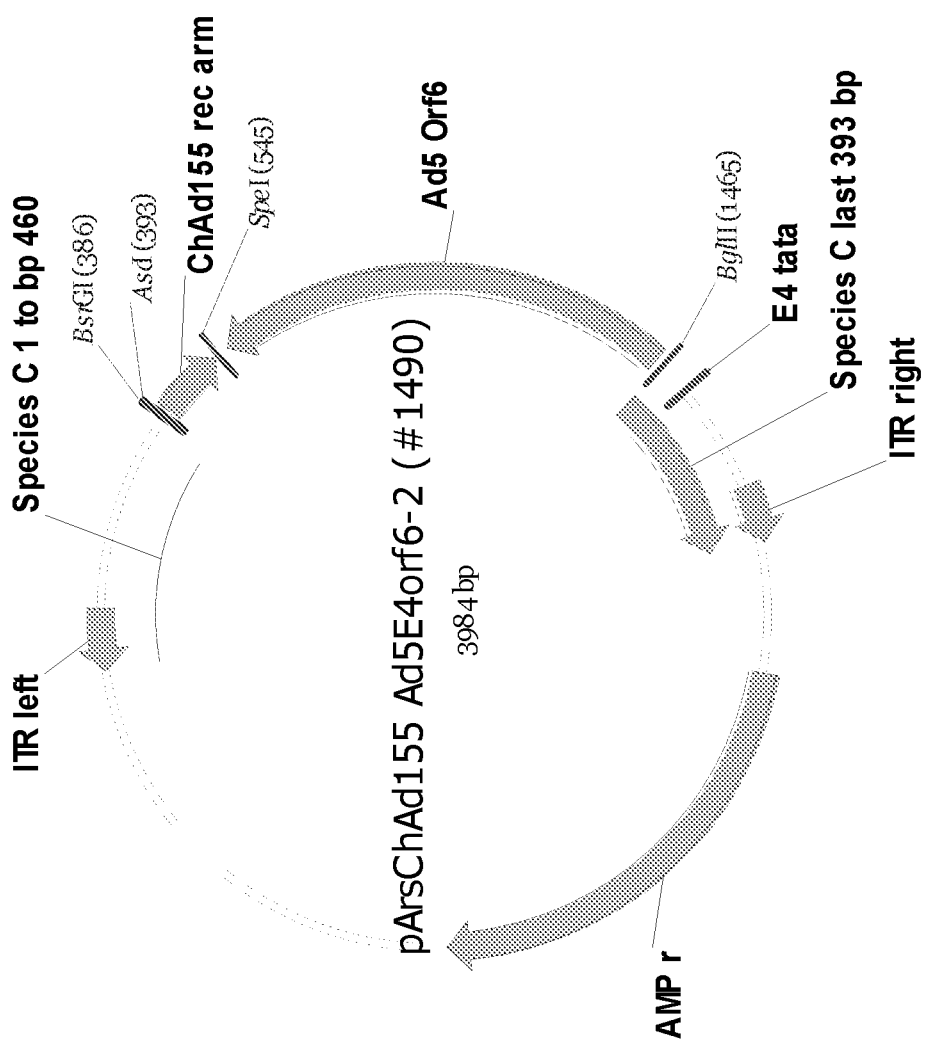
FIG. 4: pArsChAd155 Ad5E4orf6-2 (#1490) schematic.

To delete the E4 region, a 177 bp DNA fragment spanning bp 34586 to bp 34730 of the ChAd155 wt sequence (SEQ ID NO: 10) was amplified by PCR using the plasmid BAC/ChAd155 ΔE1_TetO hCMV RpsL-Kana (#1375) as a template with the following oligonucleotides: 5'-AT-TCAGTGTA CAGGCGCGCC AAAGCATGAC GCTGTTGATT TGATTC-3' (SEQ ID NO: 15) and 5'-ACT-AGGACTA GTTATAAGCT AGAATGGGGC TTTGC-3' (SEQ ID NO: 16). The PCR fragment was digested with BsrGI and SpeI and cloned into pARS SubGroupC Ad5orf6-1 digested with BsrGI and SpeI, generating the plasmid pARS SpeciesC Ad5orf6-2 (#1490). A schematic diagram of this shuttle plasmid is provided in FIG. 4. In particular, the shuttle plasmid comprised the following features: Left ITR: bp 1 to 113, Species C first 460 bp: bp 1 to 460, ChAd155 wt (bp 34587 to bp 34724 of SEQ ID NO:10): bp 516 to 650, Ad5 orf6: bp 680 and 1561, Species C last 393 bp: bp 1567 to 1969, Right ITR: bp 1857 to 1969.

Construction of pChAd155 ΔE1, ΔE4 Ad5E4Orf6/TetO hCMV RpsL-Kana (#1434)

The resulting plasmid pARS SubGroupC Ad5orf6-2 was then used to replace the E4 region within the ChAd155 backbone with Ad5orf6. To this end the plasmid BAC/ChAd155 ΔE1_TetO hCMV RpsL-Kana (#1375) was digested with PacI/PmeI and co-transformed into BJ5183 cells with the digested plasmid pARS SubGroupC Ad5orf6-2 BsrGI/AscI, to obtain the pChAd155 ΔE1, ΔE4_Ad5E4orf6/TetO hCMV RpsL-Kana (#1434) pre-adeno plasmid.

Figure 9:
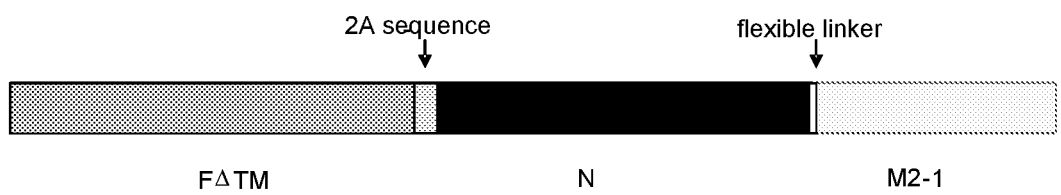
FIG. 9: Schematic of the synthetic DNA fragment used to express RSV antigens by the ChAd155-RSV vector.

2.2.2: Insertion of RSV Expression Cassette—Construction of pChAd155 ΔE1, ΔE4_Ad5E4orf6/TetO hCMV RSV An expression cassette for Human Respiratory Syncytial Virus (RSV) antigens (specifically, fusion (F) protein deleted of transmembrane and cytoplasmic regions (RSV FΔTM), RSV M2-1 (transcription anti-termination) and N (nucleocapsid) antigens) (RSV FΔTM-N-M2-1 amino acid sequence at SEQ ID NO:37) was inserted into a ChAd155 vector. The RSV antigens were computational consensus sequences derived from the alignment of many different subgroup A RSV isolates retrieved from the National Centre for Biotechnology Information (NCBI) database. For each antigen, the protein consensus sequence was derived using Multiple Sequence Comparison by Log-Expectation (MUSCLE) version 3.6 by alignment of all non-identical sequences and applying the majority rule. Each antigenic sequence was codon-optimized for expression in eukaryotic cells, chemically synthesized and assembled. The construct, shown in FIG. 9 contains the aphthovirus (Foot and Mouth Disease) Virus 2A ribosome skipping sequence ("2A") between the soluble F protein FΔTM and the other two RSV antigens, which mediates polyprotein processing by a translational effect known as ribosomal skip (Donnelly et al., (2001)). After transfection into mammalian cells, cleavage occurs and the soluble F protein is detected in the cell culture supernatant. The fusion protein N-M2-1 is instead expressed and detected in the intracellular fraction.

Figure 5:
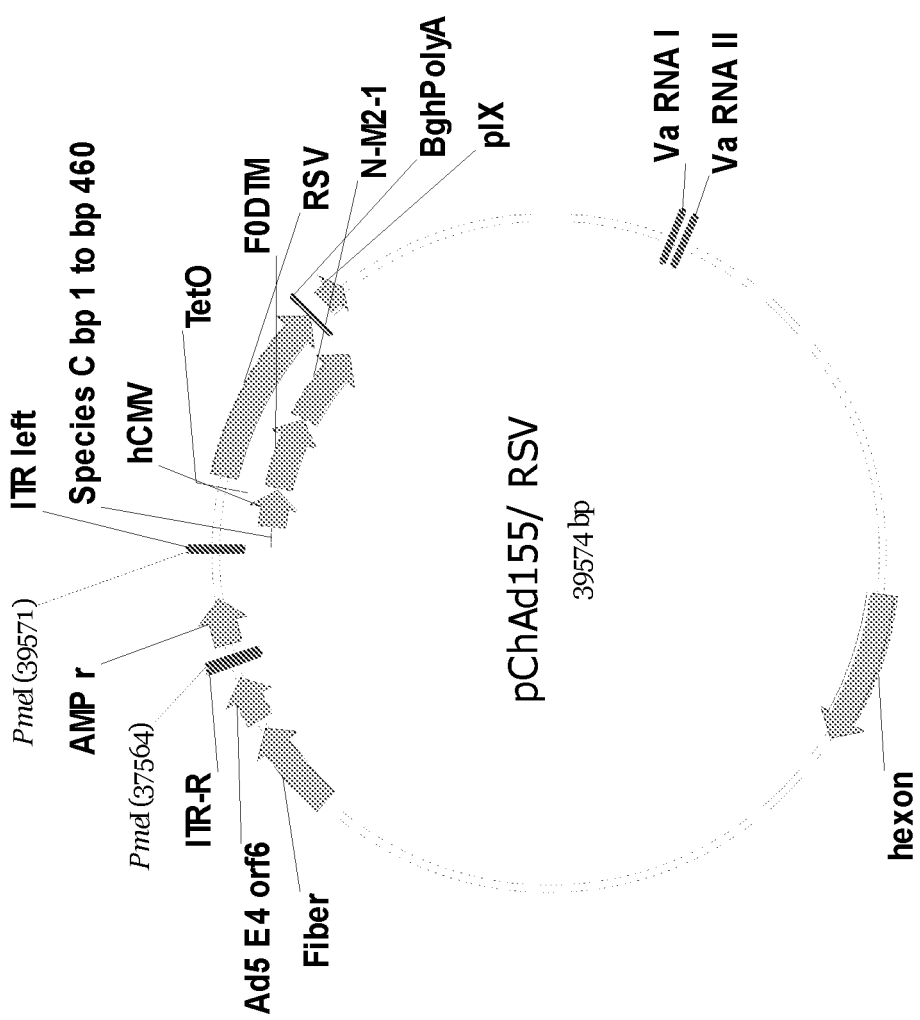
FIG. 5: pChAd155/RSV schematic.

An RSV cassette was cloned into a linearised pre-adeno acceptor vector via homologous recombination in *E. coli* by exploiting the homology existing between HCMV promoter and BGH polyA sequences. The plasmid pvjTetOhCMV-bghpolyA_RSV was cleaved with SfiI and SpeI to excise the 4.65 Kb fragment containing the HCMV promoter with tetO, RSV and BGHpolyA sequence. The resulting RSV 4.65 Kb fragment was cloned by homologous recombination into the pChAd155 ΔE1, ΔE4 Ad5E4orf6/TetO hCMV RpsL-Kana (#1434) acceptor vector carrying the RpsL-Kana selection cassette under control of HCMV and BGHpA. The acceptor pre-adeno plasmid was linearized with the restriction endonuclease SnaBI. The resulting construct was the pChAd155 ΔE1, ΔE4_Ad5E4orf6/TetO hCMV RSV vector (FIG. 5).

2.3: BAC Vector Construction by Recombineering 2.3.1: Deletion of E4 Region—Construction of BAC/ChAd155 ΔE1, ΔE4_Ad5E4orf6/TetO hCMV RpsL-Kana #1390

A deletion of the E4 region spanning from nucleotide 34731-37449 of the ChAd155 wt sequence was introduced in the vector backbone by replacing this native E4 region with the Ad5 E4orf6 coding sequence using a strategy involving two different steps of recombineering in *E. coli* SW102 competent cells.

The first step resulted in insertion of a selection cassette including the suicide gene SacB, ampicilling-R gene and lacZ (Amp-LacZ-SacB selection cassette) in the E4 region of ChAd155, for the purpose of positive/negative selection of recombinants First Step—Substitution of ChAd155 Native E4 Region with Amp-LacZ-SacB Selection Cassette The Amp-LacZ-SacB selection cassette was amplified by PCR using the oligonucleotides provided below containing E4 flanking sequences to allow homologous recombination: 1021-FW E4 Del Step1 (5'-TTAATAGACA CAGTAGCTTA ATAGACCCAG TAGTGCAAAG CCCCATTCTA GCTTATAACC CCTATTTGTT TATTTTTCT-3') (SEQ ID NO: 17) and 1022-RW E4 Del Step1 (5'-ATATATACTC TCTCGGCACT TGGCCTTTTA CACTGCGAAG TGTTGGTGCT GGTGCTGCGT TGAGAGATCT TTATTTGTTA ACTGTTAATT GTC-3') (SEQ ID NO: 18).

The PCR product was used to transform *E. coli* SW102 competent cells containing the pAdeno plasmid BAC/ChAd155 (ΔE1) tetO hCMV-RpsLKana #1375. The transformation of SW102 cells allowed the insertion of the selection cassette in the E4 region of ChAd155 via lambda (λ) Red-mediated homologous recombination, thus obtaining BAC/ChAd155 (ΔE1) TetOhCMV-RpsL Kana #1379 (including Amp-LacZ-SacB cassette by substituting ChAd155 native E4 region).

Second Step—Substitution of Amp-lacZ-SacB Selection Cassette with Ad5E4Orf6 Region The resulting plasmid BAC/ChAd155 (ΔE1) TetO hCMV-RpsL Kana #1379 (with Amp-LacZ-SacB cassette in place of ChAd155 E4 region) was then manipulated to replace the Amp-lacZ-SacB selection cassette with Ad5orf6 within the ChAd155 backbone. To this end, a DNA fragment containing the Ad5orf6 region was obtained by PCR, using the oligonucleotides 1025-FW E4 Del Step2 (5'-TTAATAGACA CAGTAGCTTA ATA-3') (SEQ ID NO: 19) and 1026-RW E4 Del Step2 (5'-GGAAGGGAGT GTCTAGTGTT-3') (SEQ ID NO: 20). The resulting DNA fragment was introduced into *E. coli* SW102 competent cells containing the pAdeno plasmid BAC/ChAd155 (ΔE1) TetO hCMV-RpsL Kana) #1379, resulting in a final plasmid BAC/ChAd155 (ΔE1, ΔE4 Ad5E4orf6) TetO hCMV-RpsL Kana #1390 containing Ad5orf6 substituting the native ChAd155 E4 region.

2.3.2: Insertion of RSV Expression Cassette: Construction of BAC/ChAd155 ΔE1, ΔE4_Ad5E4orf6/TetOhCMV RSV #1393

An RSV transgene was cloned into the BAC/ChAd155 ΔE1, ΔE4_Ad5E4orf6/TetOhCMV RpsL Kana #1390 vector by substituting the RpsL-Kana selection cassette. The construction strategy was based on two different steps of recombineering in *E. coli* SW102 competent cells.

First Step—Substitution of RpsL-Kana Cassette with Amp-LacZ-SacB Selection Cassette:

The Amp-LacZ-SacB selection cassette was obtained from plasmid BAC/ChAd155 (ΔE1) TetO hCMV Amp-LacZ-SacB #1342 by PCR using the oligonucleotides 91-SubMonte FW (5'-CAATGGGCGT GGATAGCGGT TTGAC-3') (SEQ ID NO: 21) and 890-BghPolyA RW (5'-CAGCATGCCT GCTATTGTC-3') (SEQ ID NO: 22). The product was transformed into *E. coli* SW102 competent cells containing the pAdeno plasmid BAC/ChAd155 (ΔE1, ΔE4 Ad5E4orf6) TetOhCMV-RpsL Kana #1390, resulting in BAC/ChAd155 (ΔE1, ΔE4 Ad5E4orf6) TetO hCMV-Amp-LacZ-SacB #1386.

Figure 6:
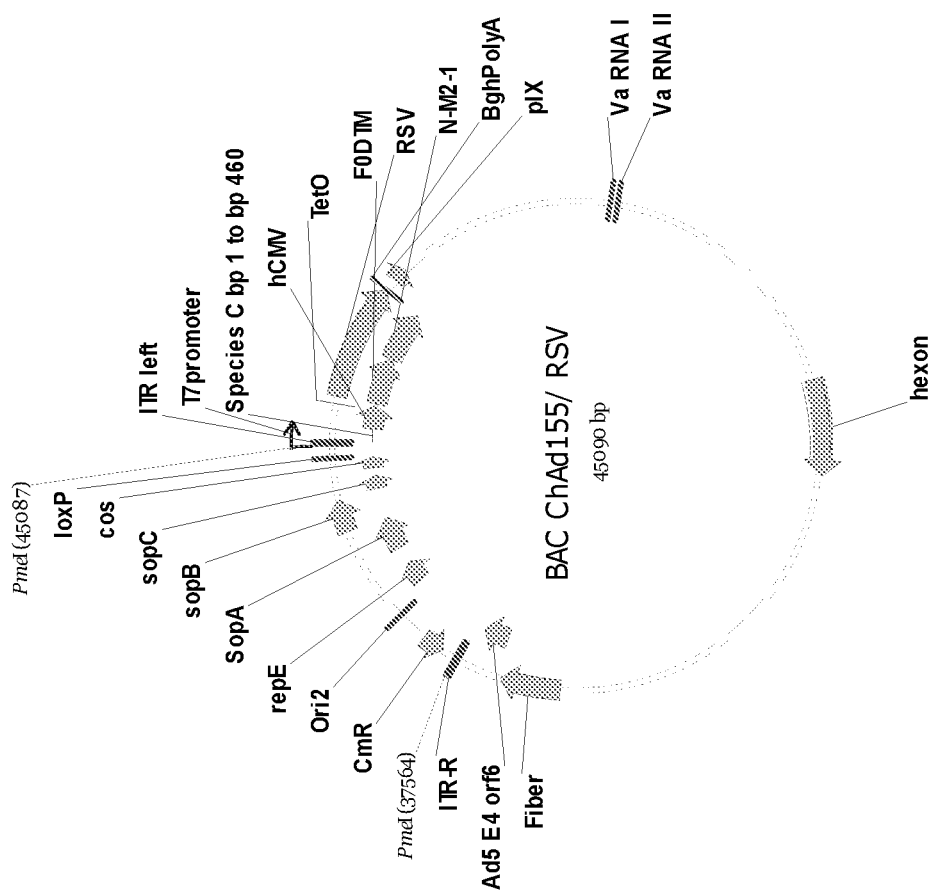
FIG. 6: BAC ChAd155/RSV schematic.

Second Step—Substitution of Amp-lacZ-SacB Selection Cassette with RSV Transgene:

The RSV transgene was inserted in plasmid BAC/ChAd155 (ΔE1, ΔE4 Ad5E4orf6) TetO hCMV-Amp-LacZ-SacB #1386 by replacing the Amp-lacZ-SacB selection cassette by homologous recombination. To this end, the plasmid pvjTetOhCMV-bghpolyA_RSV #1080 (containing an RSV expression cassette) was cleaved with SpeI and SfiI to excise the 4.4 Kb fragment including the HCMV promoter, RSV and BGHpolyA. The resulting RSV 4.4 Kb fragment was transformed into E. coli SW102 competent cells containing the pAdeno plasmid BAC/ChAd155 (ΔE1, Δ E4 Adr5E4orf6) TetOhCMV-Amp-LacZ-SacB #1386, resulting in the final plasmid BAC/ChAd155 ΔE1, ΔE4_Ad5E4orf6/TetO hCMV RSV #1393. The structure of the BAC carrying ChAd155/RSV (SEQ ID NO: 11) is illustrated in FIG. 6. In particular, ChAd155/RSV comprised the following features: Species C Left ITR: bp 1 to 113, hCMV(tetO) bp 467 to 1311, RSV gene: bp 1348 to 4785, bghpolyA: bp 4815 to 5032, Ad5E4orf6: bp 36270 to 37151, Species C Right ITR: bp 37447 to 37559.

Example 3: Vector Production

The productivity of ChAd155 was evaluated in comparison to ChAd3 and PanAd3 in the Procell 92 cell line.

3.1: Production of Vectors Comprising an HIV Gag Transgene

The HIV genome encodes a number of different proteins, each of which can be immunogenic in its entirety or as a fragment. Envelope proteins include gp120, gp41 and Env precursor gp160, for example. Non-envelope proteins of HIV include internal structural proteins such as the products of the gag and pol genes. The Gag gene gives rise to the 55-kilodalton (kD) Gag precursor polyprotein (also called p55), which is cleaved by protease to yield products including the matrix protein (p17), the capsid (p24), the nucleocapsid (p9), p6 and two space peptides, p2 and p1, all of which are examples of fragments of Gag.

Vectors expressing the HIV Gag protein were prepared as described above (ChAd155/GAG) or previously (ChAd3/GAG Colloca et al, (2012)). ChAd3/GAG and ChAd155/GAG were rescued and amplified in Procell 92 until passages 3 (P3); P3 lysates were used to infect 2 T75 flasks of Procell 92 cultivated in monolayer with each vector. A multiplicity of infection (MOI) of 100 vp/cell was used for both infection experiments. The infected cells were harvested when full CPE was evident (72 hours post-infection) and pooled; the viruses were released from the infected cells by 3 cycles of freeze/thaw (-70°/37° C.) then the lysate was clarified by centrifugation. The clarified lysates were quantified by Quantitative PCR Analysis with primers and probe complementary to the CMV promoter region. The oligonucleotide sequences are the following: CMVfor 5'-CATCTACGTA TTAGTCATCG CTATTACCA-3' (SEQ ID NO: 23), CMVrev 5'-GACTTGGAAA TCCCCGTGAG T-3' (SEQ ID NO: 24), CMVFAM-TAMRA probe 5'-ACATCAATGG GCGTGGATAG CGGTT-3' (SEQ ID NO: 25) (QPCRs were run on ABI Prism 7900 Sequence detector—Applied Biosystem). The resulting volumetric titers (vp/ml) measured on clarified lysates and the specific productivity expressed in virus particles per cell (vp/cell) are provided in Table 1 below.

TABLE 1

| Vector productivity from P3 lysates. | | | |
|---|---|---|---|
| Vector | vp/ml | Total vp (20 ml conc.) | vp/cell |
| ChAd3/GAG | 9.82E+09 | 1.96E+11 | 6.61E+03 |
| ChAd155/GAG | 1.11E+10 | 2.22E+11 | 7.46E+03 |

To confirm the higher productivity of the ChAd155 vector expressing HIV Gag transgene, a second experiment was performed by using purified viruses as inoculum. To this end, Procell 92 cells were seeded in a T25 Flask and infected with ChAd3/GAG and ChAd155/GAG when the confluence of the cells was about 80%, using a MOI=100 vp/cell of infection. The infected cells were harvested when full CPE was evident; the viruses were released from the infected cells by freeze/thaw and clarified by centrifugation. The clarified lysates were quantified by Quantitative PCR Analysis by using following primers and probe: CMV for 5'-CATCTACGTA TTAGTCATCG CTATTACCA-3' (SEQ ID NO: 23), CMV rev GACTTGGAAA TCCCCGTGAG T (SEQ ID NO: 24), CMV FAM-TAMRA probe 5'-ACATCAATGG GCGTGGATAG CGGTT-3' (SEQ ID NO: 25) complementary to the CMV promoter region (samples were analysed on an ABI Prism 7900 Sequence detector—Applied Biosystems). The resulting volumetric titers (vp/ml) measured on clarified lysates and the specific productivity expressed in virus particles per cell (vp/cell) are provided in Table 2 below.

TABLE 2

| Vector productivity from purified viruses. | | | |
|---|---|---|---|
| Vector | vp/ml | Total vp/T25 flask (5 ml of lysate) | vp/cell |
| ChAd3/GAG | 1.00E+10 | 5.00E+10 | 1.67E+04 |
| ChAd155/GAG | 1.21E+10 | 6.05E+10 | 2.02E+04 |

3.2: Production of Vectors Comprising an RSV Transgene

A different set of experiments were performed to evaluate the productivity of RSV vaccine vectors in Procell 92.S cultivated in suspension. The experiment compared PanAd3/RSV (described in WO2012/089833) and Chad155/RSV in parallel by infecting Procell 92.S at a cell density of $5 \times 10^5$ cells/ml. The infected cells were harvested 3 days post infection; the virus was released from the infected cells by 3 cycles of freeze/thaw and the lysate was clarified by centrifugation. The clarified lysates were then quantified by Quantitative PCR Analysis as reported above. The volumetric productivity and the cell specific productivity are provided in Table 3 below.

TABLE 3

| Virus | Volumetric productivity (Vp/ml) | Total vp | Cell specific productivity (vp/cell) |
|---|---|---|---|
| PanAd3/RSV | 5.82E+09 | 2.91E+11 | 1.16E+4 |
| ChAd155/RSV | 3.16E+10 | 1.58E+12 | 6.31E+04 |

Example 4: Transgene Expression Levels 4.1: Expression Level of HIV Gag Transgene Expression levels were compared in parallel experiments by infecting HeLa cells with ChAd3 and ChAd155 vectors comprising an HIV Gag transgene. HeLa cells were seeded in 24 well plates and infected in duplicate with ChAd3/GAG and ChAd155/GAG purified viruses using a MOI=250 vp/cell. The supernatants of HeLa infected cells were harvested 48 hours post-infection, and the production of secreted HIV GAG protein was quantified by using a commercial ELISA Kit (HIV-1 p24 ELISA Kit, PerkinElmer Life Science). The quantification was performed according to the manufacturer's instruction by using an HIV-1 p24 antigen standard curve. The use of ChAd3/GAG resulted in 1686 pg/ml of secreted GAG protein; use of ChAd155/GAG resulted in 2001 pg/ml of secreted GAG protein.

4.2: Expression Level of RSV F Transgene

Expression levels were compared in parallel experiments by infecting HeLa cells with the above-described PanAd3 and ChAd155 vectors comprising an RSV F transgene. To this end, HeLa cells were seeded in 6 well plates and infected in duplicate with PanAd3/RSV and ChAd155/RSV purified viruses using a MOI=500 vp/cell. The supernatants were harvested 48 hours post-infection, and the production of secreted RSV F protein was quantified by ELISA. Five different dilutions of the supernatants were transferred to microplate wells which are coated with a commercial mouse anti-RSV F monoclonal antibody. The captured antigen was revealed using a secondary anti-RSV F rabbit antiserum followed by Biotin-conjugated anti-rabbit IgG, then by adding Streptavidin-AP conjugate (BD Pharmingen cat. 554065). The quantification was performed by using an RSV F protein (Sino Biological cat. 11049-V08B) standard curve. The results obtained, expressed as µg/ml of RSV F protein, are provided in Table 4 below.

TABLE 4

| Sample | µg/ml RSV F protein |
|---|---|
| ChAd155/RSV | 5.9 |
| PanAd3/RSV | 4 |

A western blot analysis was also performed to confirm the higher level of transgene expression provided by the ChAd155 RSV vector relative to the PanAd3 RSV vector. HeLa cells plated in 6 well plates were infected with PanAd3/RSV and ChAd155/RSV purified viruses using MOI=250 and 500 vp/cell. The supernatants of HeLa infected cells were harvested and the production of secreted RSV F protein were analysed by non-reducing SDS gel followed by Western Blot analysis. Equivalent quantities of supernatants were loaded on non-reducing SDS gel; after electrophoresis separation, the proteins were transferred to a nitrocellulose membrane to be probed with an anti-RSV F mouse monoclonal antibody (clone RSV-F-3 catalog no: ABIN308230 available at antibodies-online.com (last accessed 11 Aug. 2016)). After the incubation with primary antibody, the membrane was washed and then incubated with anti-mouse HRP conjugate secondary antibody. Finally, the assay was developed by electrochemiluminescence using standard techniques (ECL detection reagents Pierce catalog no W3252282). Western Blot results: a band of about 170 kD (corresponding to the expected weight of trimeric F protein) was revealed by monoclonal antibody mAb 13 raised against the F protein, for ChAd155RSV vector (at both MOI=250 and MOI=500) and for PanAd3RSV vector (at both MOI=250 and MOI=500). However, the ChAd155 RSV vector produced a darker band at both MOI=250 and 500 vp/cell, compared to PanAd3RSV vector at MOI=250 and 500 vp/cell.

Figure 7:
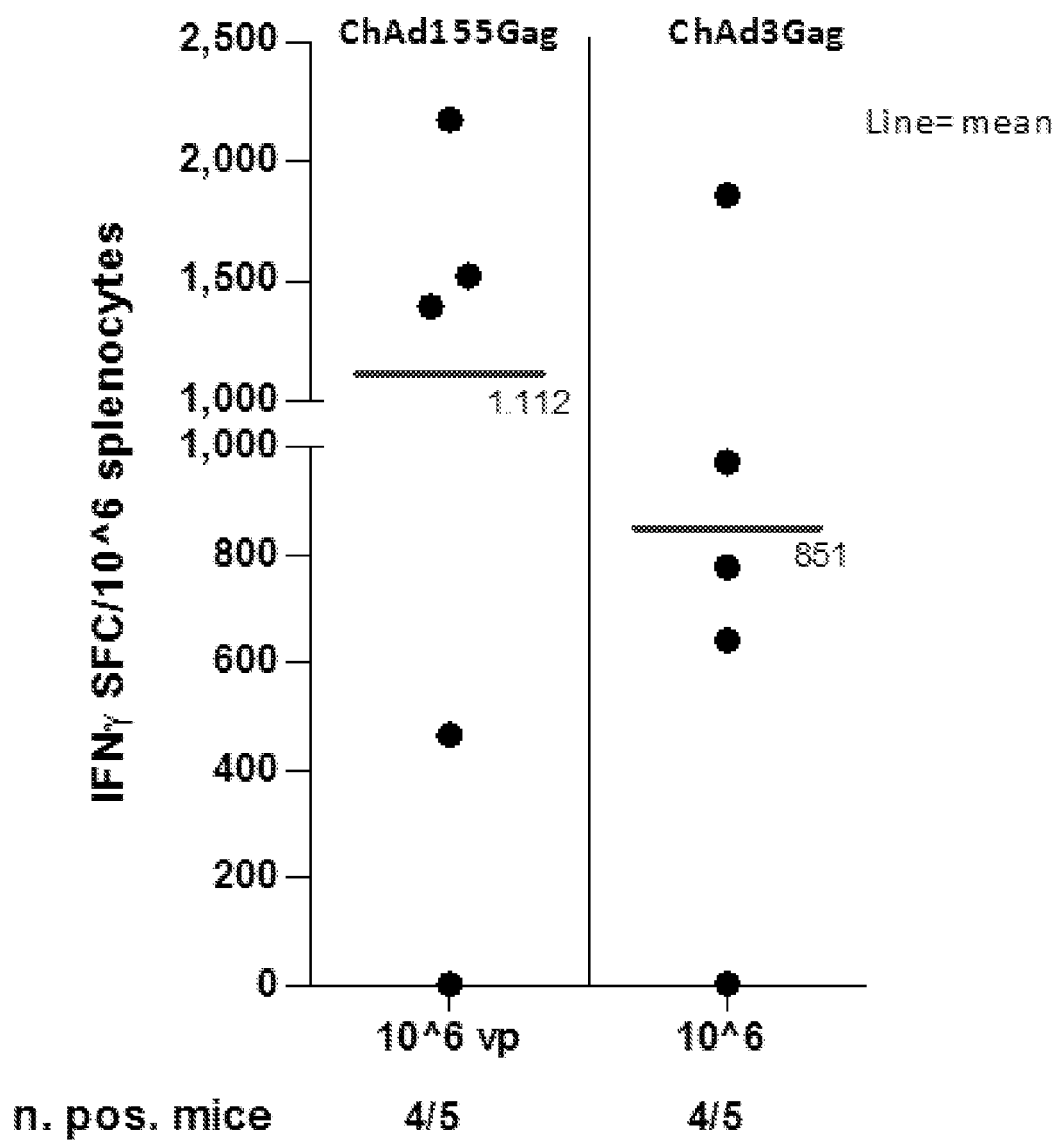
FIG. 7: Immunogenicity of ChAd3 and ChAd155 vectors expressing an HIV Gag transgene—IFN-gamma ELISpot.

Example 5: Evaluation of Immunological Potency by Mouse Immunization Experiments 5.1: Immunogenicity of Vectors Comprising the HIV Gag Transgene The immunogenicity of the ChAd155/GAG vector was evaluated in parallel with the ChAd3/GAG vector in BALB/c mice (5 per group). The experiment was performed by injecting $10^6$ viral particles intramuscularly. T-cell response was measured 3 weeks after the immunization by ex vivo IFN-gamma enzyme-linked immunospot (ELISpot) using a GAG CD8+ T cell epitope mapped in BALB/c mice. The results are shown in FIG. 7, expressed as IFN-gamma Spot Forming Cells (SFC) per million of splenocytes. Each dot represents the response in a single mouse, and the line corresponds to the mean for each dose group. Injected dose in number of virus particles and frequency of positive mice to the CD8 immunodominant peptide are shown on the x axis.

5.2: Immunogenicity of Vectors Comprising the RSV Transgene

Preclinical studies to evaluate the immunogenicity of the vaccine candidate ChAd155-RSV were performed in inbred BALB/c mice. The vaccine efficacy was also evaluated in cotton rats after intranasal (IN) challenge with RSV through measurement of viral load in lower (lung) or upper (nasal tissue) respiratory tract (5.2.2).

5.2.1: —Immunogenicity of Vectors Comprising the RSV Transgene in Inbred Mice

ChAd155-RSV was tested in the BALB/c mouse strain to evaluate its immunological potency. Dose escalation in inbred mice is the standard assay that has enabled the ranking of chimpanzee adenoviral vectors immunological potency in mice with results that have been confirmed consistently across species (non-human primates and humans) (Colloca et al., 2012)

Figure 8:
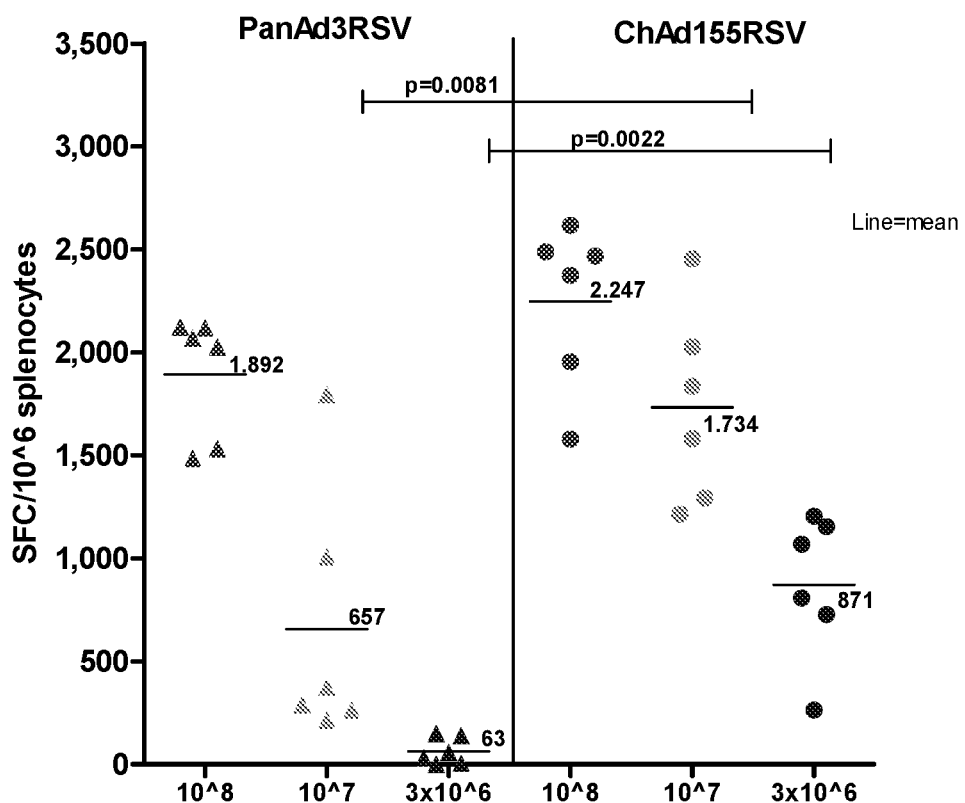
FIG. 8: Immunogenicity of PanAd3 and ChAd155 vectors expressing an HIV Gag transgene—IFN-gamma ELISpot.

The immunological potency of the PanAd3/RSV and ChAd155/RSV vectors was evaluated in BALB/c mice. Both vectors were injected intramuscularly at doses of $3 \times 10^6$, $10^7$, and $10^8$ vp. Three weeks after vaccination the splenocytes of immunized mice were isolated and analyzed by IFN-gamma-ELISpot using as antigens immunodominant peptide F and M epitopes mapped in BALB/c mice. The levels of immune-responses were reduced in line with decreasing dosage (as expected) but immune responses were clearly higher in the groups of mice immunized with ChAd155/RSV vector compared to the equivalent groups of mice immunized with PanAd3/RSV vaccine (FIG. 8). In FIG. 8, symbols show individual mouse data, expressed as IFN-gamma Spot Forming Cells (SFC)/million splenocytes, calculated as the sum of responses to the three immunodominant epitopes ($F_{51-66}$ $F_{85-93}$ and $M2-1_{282-290}$) and corrected for background. Horizontal lines represent the mean number of IFN-gamma SFC/million splenocytes for each dose group. A T cell dose response was observed in ChAd155-RSV immunized mice with all mice responding even at the low $3 \times 10^6$ vp dosage. PanAd3-RSV induced comparable responses at the highest dosage, while ChAd155-RSV induced higher responses at the two lower dosages.

Figure 10:
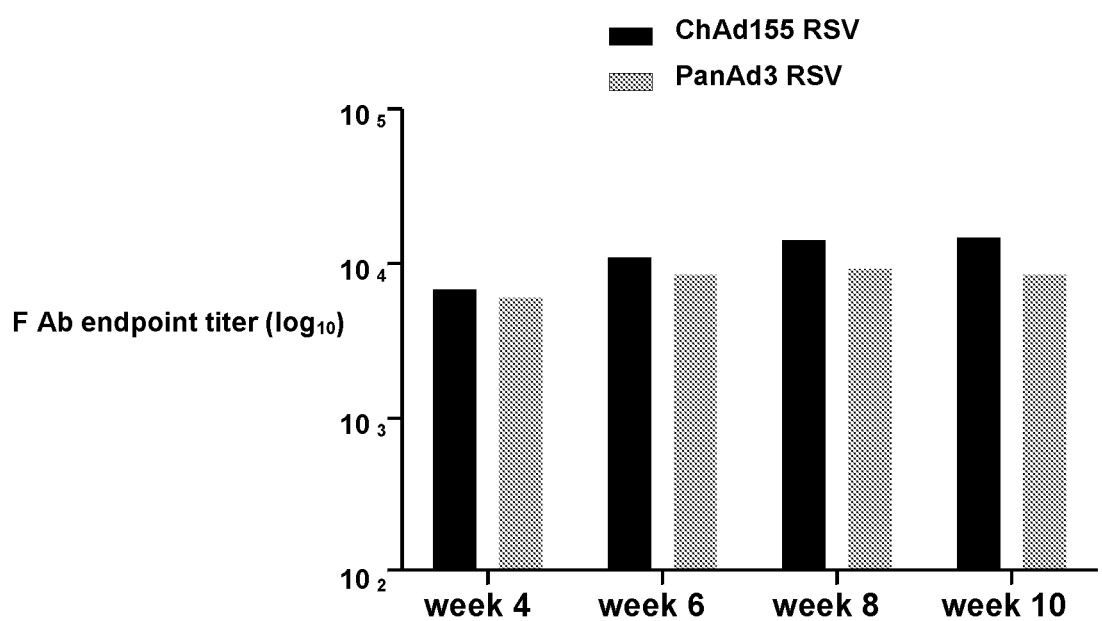
FIG. 10: Anti-F antibody titers induced by ChAd155-RSV and PanAd3-RSV in BALB/c mice.

In a second study, a group of BALB/c mice received ChAd155-RSV and another group received PanAd3-RSV, IM at a single dose of $5 \times 10^8$ vp. The mice (n=5/group) were subsequently bled every two weeks starting from Week 4 post-vaccination up to Week 10, to monitor induction and maintenance of anti F antibodies. Pooled sera from immunized mice were tested in Enzyme-Linked Immunosorbent Assay (ELISA) on coated RSV-F protein. FIG. 10 shows RSV F Immunoglobulin G (IgG) titers, measured by ELISA in pooled sera from immunized mice at different time points from vaccination. Pooled sera serial dilutions were plated in RSV-F protein coated ELISA wells, and the binding of specific IgG revealed using a goat anti-mouse IgG conjugated to Alkaline Phosphatase (AP) and p-Nitrophenyl Phosphate (pNPP) substrate. The reaction was allowed to proceed over time and read at 405 nanometres (nm) during fixed time points. Data are expressed as endpoint titers calculated as the dilution of serum giving an optical density $(OD)_{405}$ reading greater than three Standard Deviations (SDs) above the mean of pre-immune sera at a 1:100 dilution. Antibody responses to RSV F protein were induced by ChAd155-RSV and maintained over a period of 10 weeks after a single IM administration of $5 \times 10^8$ vp, and antibody titers were 1.5-fold higher at plateau than those induced by PanAd3-RSV (FIG. 10).

5.2.2: Immunogenicity of Vectors Comprising the RSV Transgene in Cotton Rats

Five groups of female, 6-8 weeks old cotton rats (8 rats/group) were immunized by the intramusculat (IM) route with $5 \times 10^8$ or $5 \times 10^7$ vp of ChAd155-RSV or PanAd3-RSV (see Table 5). A control group was left unvaccinated. Seven weeks after vaccination, the animals were challenged by intranasal (IN) inoculation with a $10^5$ pfu standard dose of RSV A (Long strain). Five days after challenge, the animals were sacrificed, the nasal tissue harvested for viral titration, and the lung en bloc collected and bisected for viral titration (left lobes) and histopathology (right lobes, Groups A, D, E only). RSV titers in nasal tissue or lung homogenates collected five days after RSV challenge were determined by a standard plaque assay on permissive cells (HEp-2 cells). FFPE lung sections were stained with Hematoxylin/Eosin. Four parameters of pulmonary inflammation were evaluated: peribronchiolitis (PB), perivasculitis (PV), interstitial pneumonia (IP), and alveolitis (A). Slides were scored blind on a 0-4 severity scale, and values were then converted to a 0-100% histopathology score. The animals were also bled at Day 0 and at the time of challenge, for RSV neutralizing antibody titration by standard plaque assay on permissive cells (Vero cells). Neutralizing antibody titers were determined as the reciprocal of the serum dilutions at which 60% of the virus was neutralized compared to virus control.

TABLE 5

Dosing scheme of cotton rats

| Group | Vaccine | Immunization dose |
|---|---|---|
| A | Control | — |
| B | PanAd3-RSV IM | $5 \times 10^8$ vp |
| C | PanAd3-RSV IM | $5 \times 10^7$ vp |
| D | ChAd155-RSV IM | $5 \times 10^8$ vp |
| E | ChAd155-RSV IM | $5 \times 10^7$ vp |

Figure 11:
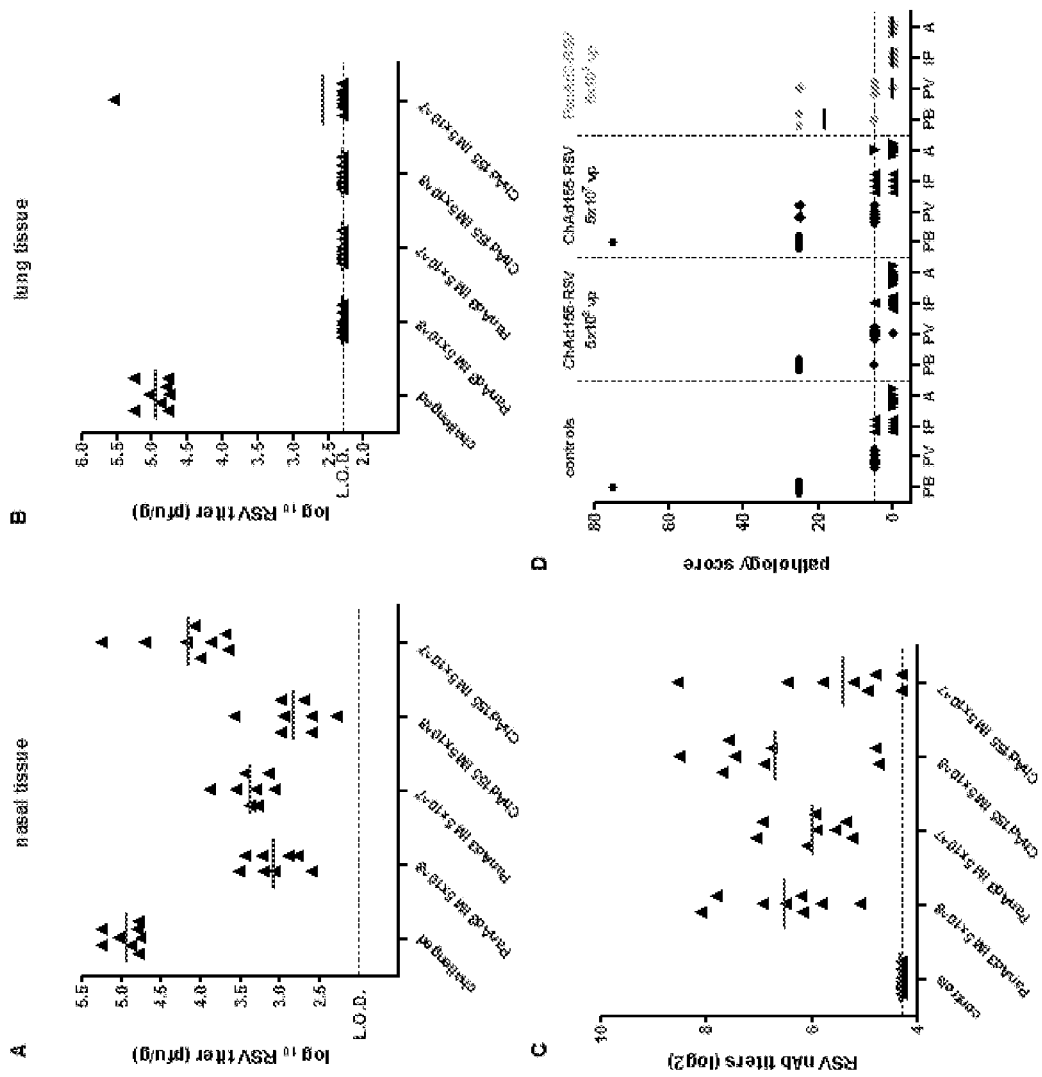
FIG. 11: RSV titers in nasal tissues (A) and lung homogenates (B), RSV neutralizing antibody (C) and pathology score (D) after viral challenge.

FIG. 11 panels A and B show the RSV viral titers from nasal tissue and lung homogenates, respectively, by plaque assay. RSV titers in nasal tissue or lung homogenates collected five days after RSV challenge were determined by a standard plaque assay on permissive cells. Data are expressed as RSV plaque forming units per gram of tissue (pfu/g). intramuscular ChAd155-RSV at both dosages completely abolished viral replication in the lung, apart from one animal at the lowest dosage. Infection of the upper respiratory tract was also significantly reduced (between 1 and 2 logs lower RSV titers recovered from nasal tissue) in a dose-dependent manner compared to unvaccinated control animals.

It has been previously shown that in cotton rats a serum neutralizing antibody titer of 1:100 or greater confers protection from viral replication in the lung (Prince, 1985). In this study both vectors administered IM at $5 \times 10^8$ vp induced RSV neutralizing antibodies in the range of the protective threshold while titers decreased with a lower vaccine dosage (FIG. 11 panel C). Nevertheless, the vaccination prevented viral replication in the lung even when serum antibody levels were below 1:100, suggesting a role for other immune effector mechanisms. RSV neutralizing antibody titers are expressed as the serum dilution reducing plaques by 60% compared to control.

5.2.3: Safety of Vectors Comprising the RSV Transgene in Cotton Rats

Lung histopathology was performed five days post-infection to assess whether vaccination with ChAd155-RSV induced vaccine-enhanced pathology. Four parameters of pulmonary inflammation were evaluated according to the presence of inflammatory cells in different areas of the lung structure: peribronchiolitis (PB, inflammatory cell infiltration around the bronchioles), perivasculitis (PV, inflammatory cell infiltration around the small blood vessels), interstitial pneumonia (IP, inflammatory cell infiltration and thickening of alveolar walls), and alveolitis (A, cells within the alveolar space). Formalin-fixed, paraffin-embedded lung sections were stained with Hematoxylin/Eosin. Slides were scored blind on a 0-4 severity scale, and values were then converted to a 0-100% histopathology score; 5% represented the threshold for significant pathology.

Among the four parameters, the presence of inflammatory infiltrate in the alveolar walls (interstitial pneumonia [IP]), and more importantly in the alveolar space, (alveolitis [A]), is considered predictive for enhanced disease and lung pathology (Prince, 2001). The results of the lung histopathology analysis (data not shown) showed that IM ChAd155-RSV did not induce significant IP and A pathology scores. Low levels of IP and A were observed, consistent with what has been observed during RSV acute infection and secondary RSV re-infection (Boukhvalova, 2013), and were comparable to values observed with PanAd3-RSV in a previous study.

Example 6: ChAd155 Vector Construction for HPV Transgene

The ChAd155 viral vector as described above for use with RSV transgenes was used for the generation of some HPV adenoviruses and was also further modified with an additional deletion in the viral E3 gene Construction of pChAd155 ΔE1, ΔE3, ΔE4_Ad5E4orf6/TetO hCMV RpsL-Kana (#pCDE144)

Figure 17:
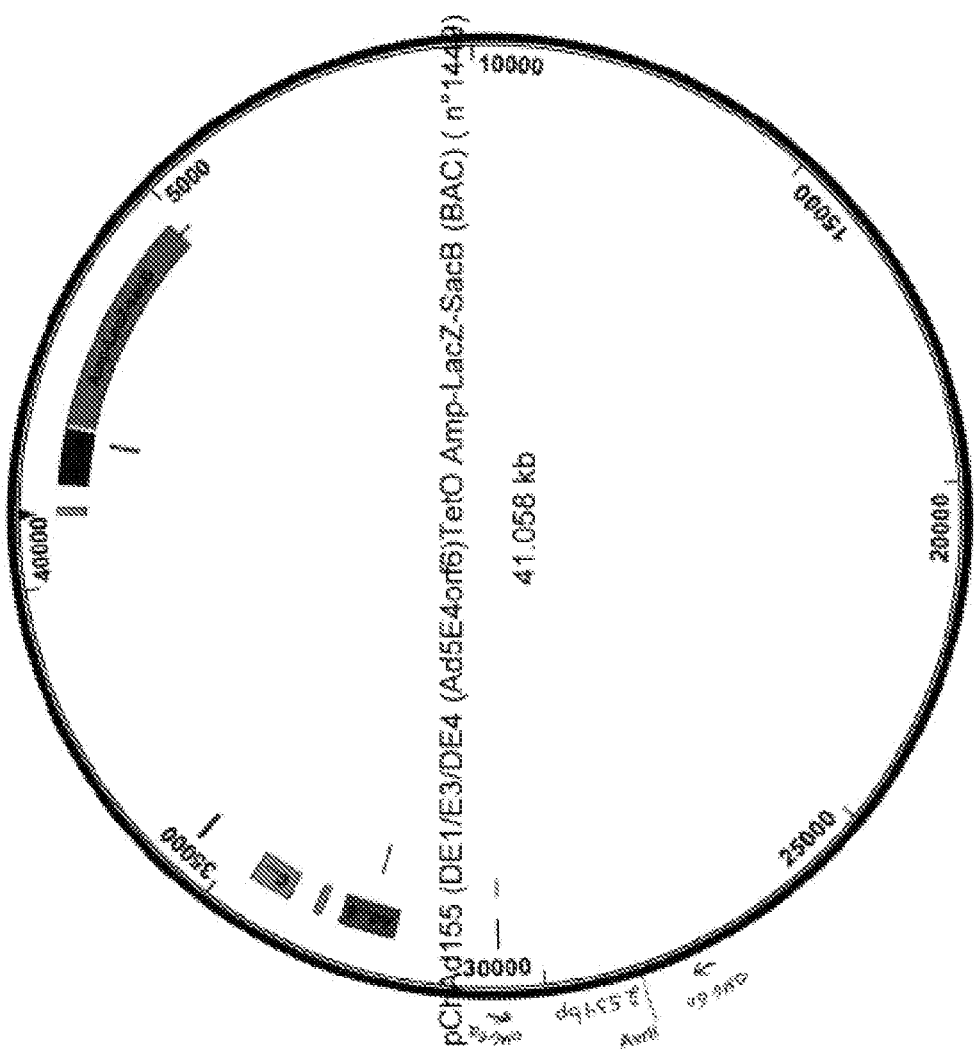
FIG. 17 diagrams pChAd155 ΔE1, ΔE3, ΔE4_Ad5E4orf6/TetO hCMV RpsL-Kana (#pCDE144) pre-adeno plasmid.

The resulting plasmid #1434 was used to delete the E3 gene within the ChAd155 backbone. To this end the plasmid pChAd155 ΔE1, ΔE4_Ad5E4orf6/TetO hCMV RpsL-Kana (#1434) was digested with AvrII and co-transformed into BJ5183 cells with the PCR product obtained by amplification using as template the plasmid pChAd155 (ΔE1, ΔE3, ΔE4_Ad5E4orf6/TetO Amp-LacZ-SacB (#1449) and the following primers: CATACATGCTTCTGGAGGAAG and CTGAGGTGCTCACAGTTAGG, to obtain the pChAd155 ΔE1, ΔE3, ΔE4_Ad5E4orf6/TetO hCMV RpsL-Kana (#pCDE144) pre-adeno plasmid (FIG. 17).

In the following experiments, the HPV transgene(s) were carried by a ChAd155 adenoviral vector with:
a) deletion of the ChAd155 E1 region (from bp 449 to bp 3529) of the viral genome;
b) deletion of the ChAd155 E4 region (from bp 34731 to bp 37449) of the viral genome;
c) insertion of the ChAd155E4orf6 derived from human Ad5;
d) deletion of the ChAd155 E3 region (from bp 28622 to bp 32622) of the viral genome (for some constructs).

The DNA sequences (HPV transgenes) were codon optimized for human expression, synthesized and cloned by GeneWiz® into a shuttle vector pvjTetOhCMV-bghpolyA under the control of the tetOhCMV promoter and bovine growth hormone poly-adenylation signal (BGH pA). Cassettes were transferred into ChAd155 1434 or pCDE144 vectors by homologous recombination in E. coli BJ5183 competent cells.

All recombinant chimp adenoviruses were generated by transfecting linear ChAd155-HPV vectors into 293 HEK Procells 92S. These cells are genetically modified to express constitutively the TetO repressor in order to repress transgene expression during virus generation. Viral amplification was performed at small scale (shake flask) and viruses were purified on double CsCl gradient from 1 Litre scale suspension culture. This purified material consists in the preclinical samples.

Titers based on Q-PCR (targeting the tetOhCMV promoter) and hexon immunostaining or by CCID50 for infectivity data are summarized in the table below:

| | Q-PCR Titer (vp/ml) | IP Titer (IFU/ml) | Ratio VP/IFU (target < 300) |
|---|---|---|---|
| E1E2E6_SimCon | 1.9 × 10*11 | 2 × 10*9 | 96 |
| E1E2E6_FL | 3 × 10*11 | 1.6 × 10*9 | 183 |
| 2A_E1E2E6_FL | 2 × 10*11 | 1.3 × 10*9 | 158 |
| E1_FL | 3.9 × 10*11 | 3.8 × 10*9 | 103 |
| E2_FL | 10*11 | 1.14 × 10*9 | 87 |
| E6_FL | 1.8 × 10*11 | 1.48 × 10*9 | 121 |
| Gly_E2$^3$E6$^5$E1$^2$E7$^2$ | 3.33E+11 | 5.40E+09 | 62 |
| Gly_E2$^3$E6$^5$ | 2.16E+11 | 3.91E+09 | 55 |
| Gly_E1$^2$E7$^2$ | 1.82E+11 | 1.34E+09 | 136 |
| 2A_E2$^3$E6$^5$ | 3.34E+11 | 2.36E+09 | 142 |
| 2A_E1$^2$E7$^2$ | 2.37E+11 | 1.38E+09 | 172 |
| Gly_E1$^2$E7$^2$ | 2.49E+11 | 1.35E+09 | 185 |
| 2A_E1$^5$E7$^2$ | 6.71E+10 | 9.74E+08 | 69 |
| Gly_E1$^5$E7$^2$ | 2.65E+11 | 4.16E+09 | 64 |
| 2A_E1$^3$E7$^2$E2$^3$ | 1.37E+11 | 2.57E+09 | 53 |
| Gly_E1$^3$E7$^2$E2$^3$ | 2.61E+11 | 5.25E+09 | 50 |
| 2A_E2$^4$E6$^7$ | 2.86E+11 | 9.61E+09 | 30 |
| Gly_E2$^4$E6$^7$ | 3.60E+11 | 2.49E+09 | 145 |
| 2A_E2$^5$E6$^6$ | 2.14E+11 | 1.04E+09 | 207 |
| Gly_E2$^5$E6$^6$ | 1.05E+11 | 2.94E+09 | 36 |

Example 7: ChAd155 Adenoviral HPV16 E1-E2-E6 Constructs

Figure 13A:
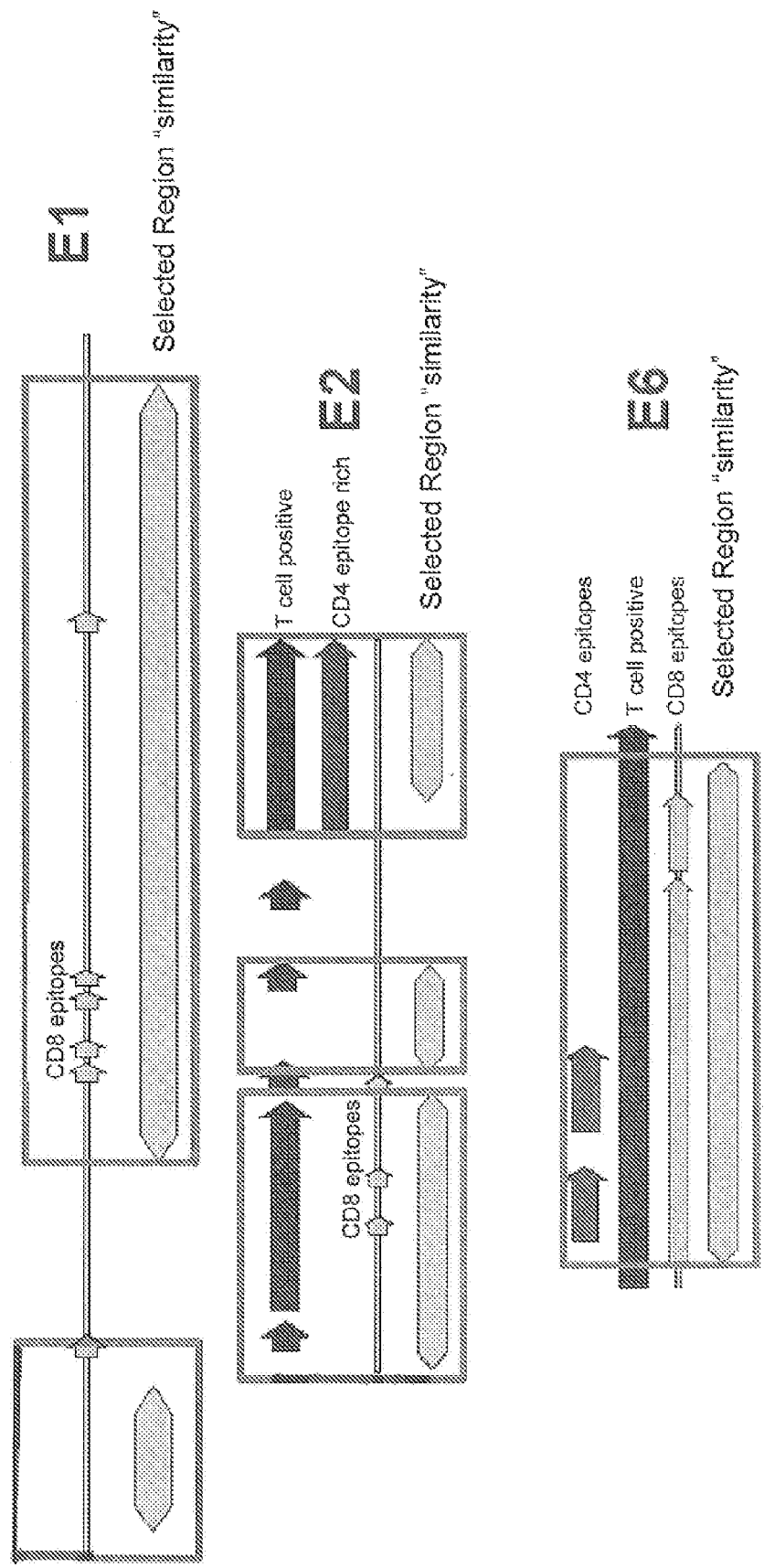
FIG. 13A illustrates, within HPV16 E1, E2 and E6, areas of sequence similarity to other HPV types, CD4 epitope rich areas, and T cell positive areas. Boxed areas indicate fragments inserted in the "SimCon" constructs as described in Example 7.

Three HPV Early proteins (E1, E2 and E6) were selected for investigation, based upon their presence within the epithelium during multiple stages of HPV infection in humans. Using HPV16 E1, E2 and E6 full-length polypeptide sequences as a starting point, HPV proteins from multiple HPV types were aligned to identify regions of similarity (performed by ClustalW multiple sequence alignment tool available from EMBL-EBI at www(.)ebi(.)ac(.)uk). Regions with a levels of sequence similarity of at least about 60% across 15 hrHPV types (types 16, 18, 31, 33, 45, 52, 58, 56, 51, 39, 35, 59, 68, 73 and 82), and comprising CD8/CD4 epitopes and/or regions with predicted T cell epitopes (Immune Epitope Database, available at www(dot)iedb.org)), were identified. (FIG. 13A).

From the 649 amino acid HPV16 E1 sequence (SEQ ID NO:39), two conserved regions were identified: aa14-90 and aa211-622. These two regions joined together provide a 489 amino acid sequence (SEQ ID NO:43).

From the 365 amino acid HPV16 E2 sequence (SEQ ID NO:40), three conserved regions were identified: aa1-138, aa150-210, and aa260-365. These three regions together provide a 305 amino acid sequence (SEQ ID NO:44)

From the 158 amino acid HPV16 E6 sequence (SEQ ID NO:41), a 140 amino acid conserved region was identified (aa8-147; SEQ ID NO:45).

A nucleotide sequence was constructed to express the E1, E2, and E6 conserved regions as a single polypeptide, with a methionine added at the N-terminal (SEQ ID NO:50; referred to as "Sim concatenation" or "SimCon").

The full length HPV16 E1, E2 and E6 sequences, and the identified regions of sequence similarity were used to create ChAd155 adenoviral constructs containing HPV nucleotide inserts as described in Table 6. Use of the 2A sequence allows independent polypeptide expression from a single mRNA. The 2A sequence induces ribosome skipping during translation; the initial 23 amino acids of the 2A sequence (SEQ ID NO:47) remain linked to the preceding antigen, the final proline residue of the 2A sequence remains attached to the next expressed antigen.

TABLE 6

| Construct Identifier | Nucleotide insert encoding*: | Expressed antigen |
|---|---|---|
| E1E2E6_SimCon | Concatenated HPV16 E1, E2 and E6 conserved regions (SEQ ID NOs: 43, 44, 45) with N-terminal methionine | Fusion of HPV16 E1, E2 and E6 segments (SEQ ID NO: 50) |
| E1E2E6_FL | HPV16 E1, E2, & E6 full length; Concatenated, no linker (SEQ ID NOs: 39, 40 and 41) | Fusion of full-length HPV16 E1, E2 and E6 (SEQ ID NO: 49) |
| 2A_E1E2E6_FL | HPV16 E1, E2, & E6: Full length proteins (SEQ ID NOs: 39, 40 and 41) separated by 2A nucleic sequence (SEQ ID NO: 46) in the nucleotide insert | Expressed as separate full length HPV16 E1, E2 and E6 polypeptides (SEQ ID NO: 39, 40, and 41) containing additional amino acids from the 2A sequence. |
| E1_FL | HPV16 E1 full length (SEQ ID NO: 39) | full length HPV16 E1 (SEQ ID NO: 39) |
| E2_FL | HPV16 E2 full length (SEQ ID NO: 40) | full length HPV16 E2 (SEQ ID NO: 40) |
| E6_FL | HPV16 E6 full length (SEQ ID NO: 41) | full length HPV16 E6 (SEQ ID NO: 41) |

*Nucleotide inserts contain nucleotide sequences encoding the listed HPV segments in the order provided, in 5'-3' direction, separated by 5xGly or 2A sequences, as indicated)

Example 8: Immunogenicity of ChAd155 HPV16 E1-E2-E6 Constructs in Mice

The ChAd155 constructs described in Table 6, above, were evaluated for their capacity to induce HPV 16-specific CD4 and/or CD8+ T cell responses to the expressed HPV antigens, and the ability to induce cross-reactivity to HPV 18. Mice strains used: CB6F1 (inbred mouse strain); CD1 (outbred mice with broader MHCI/MHCII coverage); HLA-A2/DR1 Transgenic mice (human HLAs including MHC I & MHC II)). MHCI refers to Major Histocompatibility Complex class I; MHCII to Major Histocompatibility Complex class II.

Example 8A: CB6F1 Mice—12 Mice/Group

All mice were immunized intramuscularly (i.m.) on Day 0 (D0) with either $5.10^7$ VP/mouse or $5.10^6$ VP/mouse (Table 7A). On day 23 (D23) six of the mice in each group were sacrificed (to provide 3 pools of 2 spleens) for evaluating T-cell response. The remaining six mice in each group were immunized i.m. a second time on D23 with either $10^9$ VP/mouse or $10^8$ VP/mouse and, twelve days post the second immunization, sacrificed to provide three pools of 2 spleens for evaluating T-cell response.

TABLE 7A

| Group - CB6F1 mice | N | Vaccine dose D 0 | Vaccine dose D 23 |
|---|---|---|---|
| ChAd155-HPV16 Sim Concatentation | 6 | $5.10^7$ VP/mouse | — |
|  | 6 | $5.10^7$ VP/mouse | $10^9$ VP/mouse |
| ChAd155-HPV16 Sim Concatentation | 6 | $5.10^6$ VP/mouse | — |
|  | 6 | $5.10^6$ VP/mouse | $10^8$ VP/mouse |
| ChAd155-HPV16 Full E1-E2-E6 | 6 | $5.10^7$ VP/mouse | — |
|  | 6 | $5.10^7$ VP/mouse | $10^9$ VP/mouse |
| ChAd155- HPV16 Full E1-E2-E6 | 6 | $5.10^6$ VP/mouse | — |
|  | 6 | $5.10^6$ VP/mouse | $10^8$ VP/mouse |
| ChAd155- HPV16 Full E1-E2-E6 2A | 6 | $5.10^7$ VP/mouse | — |
|  | 6 | $5.10^7$ VP/mouse | $10^9$ VP/mouse |
| ChAd155- HPV16 Full E1-E2-E6 2A | 6 | $5.10^6$ VP/mouse | — |
|  | 6 | $5.10^6$ VP/mouse | $10^8$ VP/mouse |
| ChAd155-HPV16 E1 | 6 | $5.10^7$ VP/mouse | — |
|  | 6 | $5.10^7$ VP/mouse | $10^9$ VP/mouse |
| ChAd155-HPV16 E1 | 6 | $5.10^6$ VP/mouse | — |
|  | 6 | $5.10^6$ VP/mouse | $10^8$ VP/mouse |
| ChAd155-HPV16 E2 | 6 | $5.10^7$ VP/mouse | — |
|  | 6 | $5.10^7$ VP/mouse | $10^9$ VP/mouse |
| ChAd155-HPV16 E2 | 6 | $5.10^6$ VP/mouse | — |
|  | 6 | $5.10^6$ VP/mouse | $10^8$ VP/mouse |
| ChAd155-HPV16 E6 | 6 | $5.10^7$ VP/mouse | — |
|  | 6 | $5.10^7$ VP/mouse | $10^9$ VP/mouse |
| ChAd155-HPV16 E6 | 6 | $5.10^6$ VP/mouse | — |
|  | 6 | $5.10^6$ VP/mouse | $10^8$ VP/mouse |
| PanAd3 RSV | 6 | $5.10^6$ VP/mouse | — |
|  | 6 | $5.10^6$ VP/mouse | $10^8$ VP/mouse |
| NaCl 0.9% (control) | 6 | NaCl | — |
|  | 6 | NaCl | NaCl |

Example 8B: CD-1 Mice—12 Mice/Group

All mice were immunized intramuscularly (i.m.) on Day 0 (D0) with either $10^9$ VP/mouse or $10^8$ VP/mouse (Table 7B). On day 20 (D20) six of the mice in each group were sacrificed, and T-cell response was assessed in each. The remaining six mice in each group were immunized i.m. a second time on D19 with the same dose and, fourteen days post the second immunization, sacrificed and T-cell response was assessed in each.

TABLE 7B

| Group - CD1 mice | N | Vaccine Dose D 0 | Vaccine Dose D 19 |
|---|---|---|---|
| 1. ChAd155-HPV16 E1 | 6 | $10^9$ VP/mouse | — |
|  | 6 | $10^9$ VP/mouse | $10^9$ VP/mouse |
| 2. ChAd155-HPV16 E1 | 6 | $10^8$ VP/mouse | — |
|  | 6 | $10^8$ VP/mouse | $10^8$ VP/mouse |
| 3. ChAd155-HPV16 E2 | 6 | $10^9$ VP/mouse | — |
|  | 6 | $10^9$ VP/mouse | $10^9$ VP/mouse |
| 4. ChAd155-HPV16 E2 | 6 | $10^8$ VP/mouse | — |
|  | 6 | $10^8$ VP/mouse | $10^8$ VP/mouse |

TABLE 7B-continued

| Group - CD1 mice | N | Treatment Vaccine Dose D 0 | Vaccine Dose D 19 |
|---|---|---|---|
| 5. ChAd155-HPV16 E6 | 6 | $10^9$ VP/mouse | — |
|  | 6 | $10^9$ VP/mouse | $10^9$ VP/mouse |
| 6. ChAd155-HPV16 E6 | 6 | $10^8$ VP/mouse | — |
|  | 6 | $10^8$ VP/mouse | $10^8$ VP/mouse |
| 7. ChAd155-HPV16 SimConcatenation | 6 | $10^9$ VP/mouse | — |
|  | 6 | $10^9$ VP/mouse | $10^9$ VP/mouse |
| 8. ChAd155-HPV16 SimConcatenation | 6 | $10^8$ VP/mouse | — |
|  | 6 | $10^8$ VP/mouse | $10^8$ VP/mouse |
| 9. ChAd155-HPV16 Full E1-E2-E6 | 6 | $10^9$ VP/mouse | — |
|  | 6 | $10^9$ VP/mouse | $10^9$ VP/mouse |
| 10. ChAd155-HPV16 Full E1-E2-E6 | 6 | $10^8$ VP/mouse | — |
|  | 6 | $10^8$ VP/mouse | $10^8$ VP/mouse |
| 11. ChAd155 HPV16 Full E1-E2-E6_2A | 6 | $10^9$ VP/mouse | — |
|  | 6 | $10^9$ VP/mouse | $10^9$ VP/mouse |
| 12. ChAd155 HPV16 Full E1-E2-E6_2A | 6 | $10^8$ VP/mouse | — |
|  | 6 | $10^8$ VP/mouse | $10^8$ VP/mouse |
| 13. PanAd3 RSV | 6 | $10^8$ VP/mouse | — |
|  | 6 | $10^8$ VP/mouse | $10^8$ VP/mouse |
| 14. NaCl 0.9% (control) | 6 | NaCl | — |
|  | 6 | NaCl | NaCl |

Example 8C

In a separate experiment using CD1 mice, all mice were immunized intramuscularly (i.m.) on Day 0 (D0) with $10^9$ VP/mouse (Table 7C), and sacrificed twenty days later for evaluation of T-cell response fourteen days following the second immunization.

TABLE 7C

| Group CD1 mice | N | Treatment $1^{st}$ immunization D 0 |
|---|---|---|
| 1. ChAd155-HPV16 E1 + ChAd155-HPV16 E2 + ChAd155-HPV16 E6. | 12 | $10^9$ VP/mouse |
| 2. ChAd155-HPV16 Sim Concatenation | 12 | $10^9$ VP/mouse |
| 3. ChAd155-HPV16 Full E1-E2-E6 | 12 | $10^9$ VP/mouse |
| 4. ChAd155-HPV16 Full E1-E2-E6 2A | 12 | $10^9$ VP/mouse |
| 5. NaCl 0.9% (control) | 6 | NaCl |

Example 8D

In another study, HLA A2/DR1 transgenic (tg) mice (3 mice per group) were immunized a single time (on Day 0) with $5.10^7$ VP/mouse and sacrificed at Day 21 post-immunization for evaluation of T-cell response. As control, an adenovirus construct expressing the MAGE A3 tumor protein was used (Ad5 Mage3) (Table 7D).

TABLE 7D

| Group - HLA A2/DR1 tg | N | Vaccine Dose D 0 |
|---|---|---|
| ChAd155-HPV16 SimConcatenation | 3 | $5.10^7$ VP/mouse |
| ChAd155-HPV16 E1 | 3 | $5.10^7$ VP/mouse |
| ChAd155-HPV16 E2 | 3 | $5.10^7$ VP/mouse |
| ChAd155-HPV16 E6 | 3 | $5.10^7$ VP/mouse |
| Ad5 Mage3 (control) | 2 | $5.10^7$ VP/mouse |

Example 8E

In another study, HLA A2/DR1 transgenic (tg) mice (7-8 mice per group) were immunized a single time (on Day 0) and sacrificed at Day 21 post-immunization for evaluation of T-cell response (Table 7E):

TABLE 7E

| Group - HLA A2/DR1 tg | N | Vaccine Dose D 0 |
|---|---|---|
| ChAd155-HPV16 E1 + ChAd155-HPV16 E2+ ChAd155-HPV16 E6 | 7 | $10^8$ VP/mouse |
| ChAd155-HPV16 SimConcatenation | 7 | $10^8$ VP/mouse |
| ChAd155-HPV16 Full E1-E2-E6 | 8 | $10^8$ VP/mouse |
| ChAd155-HPV16 Full E1-E2-E6 2A | 8 | $10^8$ VP/mouse |
| NaCl 0.9% (control) | 3 | NaCl |

Example 8F

In another study, HLA A2/DR1 transgenic (tg) mice (12 mice per group) were immunized a single time (on Day 0) with $10^9$ VP/mouse and sacrificed at Day 21 post-immunization for evaluation of T-cell response:

TABLE 7F

| Group - HLA A2/DR1 tg | N | Vaccine Dose D 0 |
|---|---|---|
| ChAd155-HPV16 E1 + ChAd155-HPV16 E2 + ChAd155-HPV16 E6 | 12 | $10^9$ VP/mouse |
| ChAd155-HPV16 SimConcatenation | 12 | $10^9$ VP/mouse |
| ChAd155-HPV16 Full E1-E2-E6 | 12 | $10^9$ VP/mouse |
| ChAd155-HPV16 Full E1-E2-E6 2A | 12 | $10^9$ VP/mouse |
| NaCl 0.9% (control) | 12 | NaCl |

Evaluation of T-cell response was carried out as follows: spleens were collected from mice and placed in 5 ml media (RPMI 1640, supplemented with glutamine, penicillin/streptomycin, sodium pyruvate, non-essential amino acids, and 2-mercaptoethanol). Spleens were crushed using a potter and the cell suspension placed into a 100 um cell strainer.

After rinsing the cell strainer with 5 ml media, the volume of the spleen suspension was adjusted to 25 ml using media. Splenocytes were centrifuged at 335 g for 10 minutes at room temperature (RT), the supernatant discarded and the cell pellet was resuspended in 10 ml media for counting. After counting, cells were centrifuged again (1200 rpm for 10 minutes at RT) and the cell pellet was resuspended at $10^7$ cells/ml in Complete Medium (RPMI 1640, supplemented with glutamine, penicillin/streptomycin, sodium pyruvate, non-essential amino acids, 2-mercaptoethanol, and 5% heat inactivated fetal calf serum (FCS)).

In vitro stimulation of splenocytes was carried out as follows: splenocytes were placed in round-bottom 96-well plates at approximately 1 million cells per well. Splenocytes were restimulated with HPV-16 E1 and/or E2 and/or E6 peptides (overlapping 15mer peptides as described below) or medium with anti CD28 (clone 37.51) and anti-CD49d (clone 9C10 (MFR4.B) at 1 µg/ml for two hours at 37° C. Cells were then incubated for four hours in the presence of Brefeldin A (1 µg/ml) at 37° C. to inhibit cytokine secretion. Plates were then transferred at 4° C. and incubated overnight.

Peptide used for in vitro re-stimulation: pools of HPV peptides contained 15mer peptides overlapping by 11 amino acids. A pool was created for each of full-length HPV16 E1, E2 and E6 (specific response) and full-length HPV18 E1, E2 and E6 (cross-reactive response).

Intracellular Cytokine Staining (ICS) was performed as follows: cell suspensions were placed in v-bottom 96-well plates, pelleted (1000 rpm, 5 minutes, at 4° C.) and washed in 250 µl phosphate-buffered saline (PBS) 1% FCS containing 2% Fc blocking reagent (1/50; 2.4G2). After 10 minutes incubation at 4° C., 50 µl of a mixture of anti-CD4-V450 (clone RM4-5 (1/100), anti-CD8-PerCp-Cy5.5 (clone 53-6.7) (1/100) and live and dead fixable yellow dead cell stain (1/1000) was added and incubated 30 minutes at at 4° C. Cells were pelleted (1000 rpm, 5 minutes, at 4° C.), washed with PBS 1% FCS, centrifuged again and the cell pellets were permeabilized by resuspending in 200 µl of Cytofix-Cytoperm (Kit BD) and incubated 20 minutes at 4° C. Cells were then washed with Perm Wash (Kit BD) and resuspended with 50 µl of anti-IFNγ APC (1/200)+anti-IL-2 FITC (1/400)+anti-TNFa PE (1/700) diluted in PermWash. After 1 hour incubation at 4° C., cells were washed with PermWash and resuspended in PBS. Stained cells were analyzed by flow cytometry using a LSRII and FlowJo software.

Live cells were identified with the Live/Dead staining and then gated with FSC/SSC and acquisition was performed on approximately 20,000 events (CD4+ T cells). The percentages of IFNγ+/IL2+/+/−TNFa producing cells were calculated on CD4+ T and CD8+ T gated populations.

Results are shown in Table 8, below. Each of the six ChAd155 constructs listed in Table 6 were immunogenic in mice. CD8+ T cell responses to all three proteins were seen in outbred CD1 mice. Some cross-reactivity was seen for E1 HPV18. CD4+ T cell response were low/undetectable in these experiments, suggesting adjuvanted recombinant proteins might be used in conjunction with the adenoviral vector constructs to increase CD4+ Tcell responses, and provide more robust overall response.

TABLE 8

| Mouse strain | Antigen | CD8 response Specific HPV16 | CD8 response Cross HPV18 | CD4 response Specific HPV16 | CD4 response Cross HPV18 |
|---|---|---|---|---|---|
| CB6F1 (inbred) | E1 | +++ | + | +/− | − |
| | E2 | − | − | + | − |
| | E6 | − | − | − | − |
| HLA-A2/DR-1 transgenic | E1 | ++ | + | − | − |
| | E2 | +/− | − | − | − |
| | E6 | +/− | − | − | − |
| CD-1 (outbred) | E1 | +++ | ++ | ++ | − |
| | E2 | ++ | − | + | − |
| | E6 | + | − | + | − |

+++ = >2%
++ = 1-2%
+ = 0.5-1%
+/− = 0.1-0.5%

There was no difference among the ChAd constructs tested, either concatentated HPV proteins or those coding for individual proteins to induce CD8 or CD4 T cells.

Example 9: Antigen Design Targeting 15 hrHPV Types

A program of antigen design was undertaken to optimize HPV antigenic peptides for broad cross-reactivity among HPV types. Linker sequences were introduced into the constructs to allow expression of individual antigenic peptides. Additionally, amino acid substitutions were introduced to eliminate activity of the expressed proteins (e.g., enzymatic activity, DNA binding domains).

The amino acid sequences of E1, E2, E6 and E7 proteins from fifteen hrHPV types were compared, and bioinformatics was used to identify regions of high sequence similarity and identity (at least 70%), and that contained CD4/CD8 epitopes. To compute the identity percentage, the number of identical residues was divided by the length of the alignment.

Antigenic regions were selected to target the fifteen hrHPV types (16, 18, 31, 33, 45, 52, 58, 56, 51, 39, 35, 59, 68, 73, and 82). As show in Table 9 and Table 10, the present researchers determined that combinations of HPV early protein sequences from specific HPV types, could be selected that provide at least 70% identity to other HPV types. In Tables 9 and 10, for each protein (E1, E2, E6 or E7), "X" squares indicate the HPV type from which a sequence was selected; percent identity or similarity to other HPV types provided by the combination of selected sequences is indicated in the other squares (blank squares indicate less than 70% similarity or identity; n/d means the comparison was not done). The percentage were computed using the formula (number of identical residues/length of alignment)×100.

TABLE 9

| | \multicolumn{4}{c}{Identity Threshold 70%} |
|---|---|---|---|---|
| | E1 | E2 | E6 | E7 |
| HPV16 | X | X | X | X |
| HPV18 | X | X | X | X |
| HPV31 | 79% | 71% | | 72% |
| HPV33 | | | 85% | |
| HPV45 | 89% | 77% | 79% | 78% |
| HPV52 | 70% | | 72% | |
| HPV58 | | | X | |
| HPV56 | | | X | |

TABLE 9-continued

Identity Threshold 70%

| | E1 | E2 | E6 | E7 |
|---|---|---|---|---|
| HPV51 | | X | | |
| HPV39 | 80% | | | |
| HPV35 | 78% | | 72% | 76% |
| HPV59 | 81% | | | |
| HPV68 | 80% | | | |
| HPV73 | | | X | |
| HPV82 | | 81% | | |

N/d = not done.

TABLE 10

Similarity Threshold 70%

| E1 | E2 | E6 | E7 |
|---|---|---|---|
| X | X | X | X |
| X | X | X | X |
| 90% | 81% | 77% | n/d |
| | 92% | | n/d |
| 95% | 88% | 91% | n/d |
| 85% | | 84% | n/d |
| | | X | n/d |
| | | X | n/d |
| | X | | n/d |
| 85% | | 74% | n/d |
| 90% | 81% | 81% | n/d |
| 93% | | 76% | n/d |
| 90% | | 77% | n/d |
| | | X | n/d |
| | 90% | | n/d |

Figure 13B:
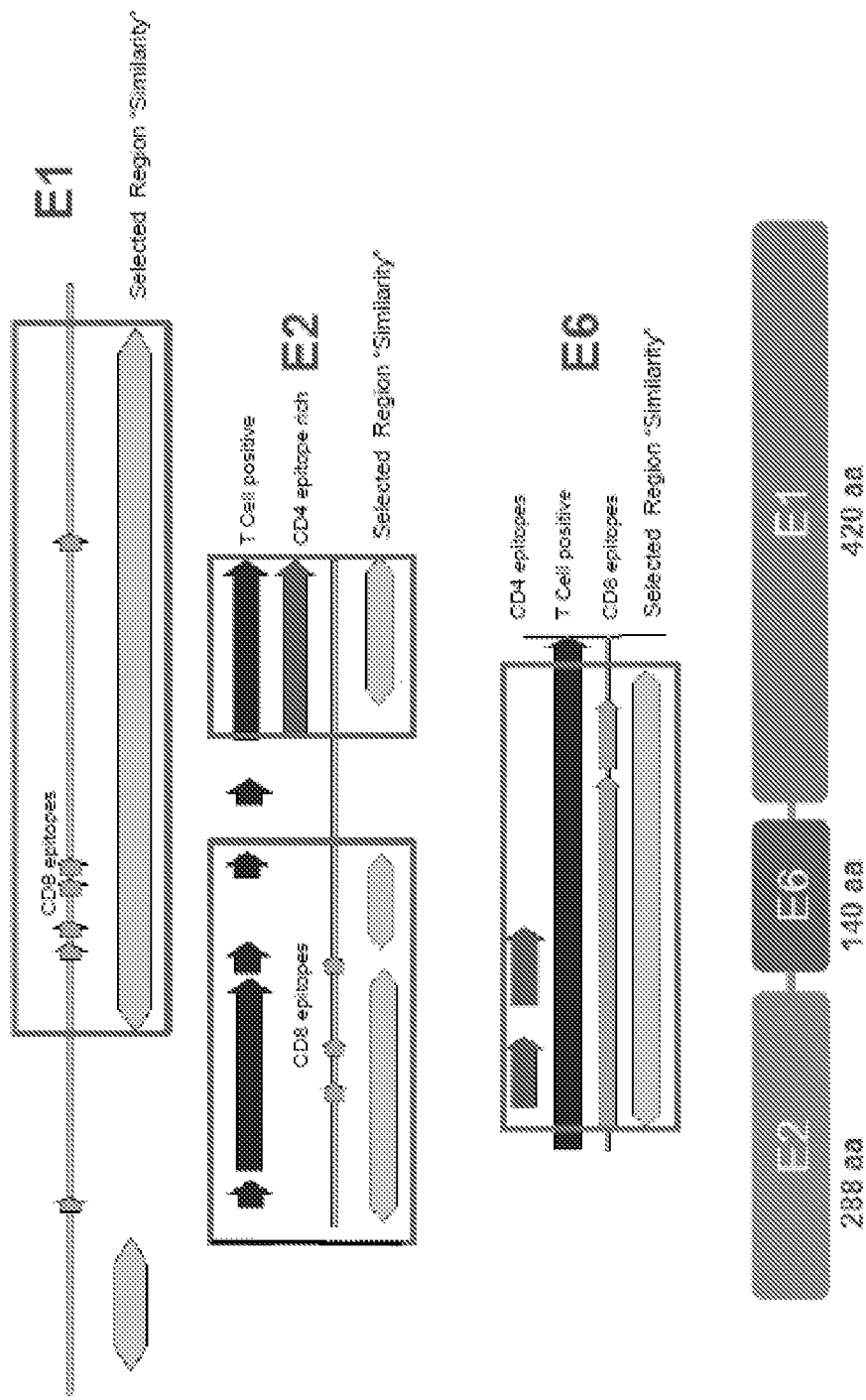
FIG. 13B illustrates within HPV16 E1, E2 and E6, areas of sequence similarity to other HPV types, CD4 epitope rich areas, and T cell positive areas. Boxed areas indicate fragments inserted in the constructs designed to target 15 hrHPV types and the constructs designed to target 7 hrHPV types.

As diagrammed in FIG. 13B, regions of HPV E1, E2, and E6 were identified for inclusion. Using a rational design approach, the selected regions of the E1, E2, E6 and E7 HPV16 antigen sequences were modified by introducing amino acid substitutions designed to eliminate the native activity of the wild-type E1, E2, E6 and E7 proteins. In the E1 protein, potential substitutions include (all amino acid numbering correlates to HPV16 E1) K285A, F392A, and G482D. In the E2 protein, potential substitutions include E39A, K111A, K306E+K307E, and D338A+E340D+W341A+D344A. In protein E6, potential substitutions include F54R and C110R. In protein E7, potential substitutions include C24G, E26Q, L67R, L82R+L84R, and C91G.

E1=aa203-622 with G482D Substitution:

The E1 construct from HPV 16 contained aa203-622 of full-length HPV 16 E1 (SEQ ID NO:39), and was modified to contain a G482D substitution. See SEQ ID NO:51. The E1 construct from HPV 18 contained amino acids corresponding to aa203-622 of HPV16 E1 (SEQ ID NO:39), with the G482D substitution. See SEQ ID NO:52.

E2=aa1-201+GGTGGS+aa285-365 with K111A Substitution:

The E2 construct from HPV 16 contained a TAD segment (amino acids aa1-201 of full-length HPV16 E2 (SEQ ID NO:40)), a GGTGGS linker, and a DBD domain segment (amino acids aa285-365 of full-length HPV16 E2 (SEQ ID NO:40)), with a K111A substitution. See SEQ ID NO:53.

The E2 constructs from HPV18 and HPV51 each contained segments corresponding the amino acids 1-201 of HPV16 E2 (SEQ ID NO:40), a GGTGGS linker, and a DBD domain segment (amino acids corresponding to aa285-365 of HPV 16 E2 (SEQ ID NO:40)), with a K111A substitution. See SEQ ID NO:54 (HPV 18 E2 construct) and SEQ ID NO:55 (HPV 51 E2 construct).

E6=aa11-150 with C110R and F54R Substitutions:

The E6 construct from HPV 16, 18, 58, 56, and 73 comprises aa11-150, with an F54R substitution and a C110R substitution (amino acid numbering corresponds to HPV 16 E6 (SEQ ID NO:41)). See SEQ ID NO:56 (HPV16 E6 construct), SEQ ID NO:57 (HPV18 E6 construct), SEQ ID NO:58 (HPV58 E6 construct), SEQ ID NO: 59 (HPV56 E6 construct), and SEQ ID NO:60 (HPV73 E6 construct).

E7=aa49-98 and aa7-28, with Fragment aa49-98 Placed N-Terminal to aa7-28, and with C24G and E26Q Substitutions:

The E7 construct comprises aa49-98 and aa7-28, with fragment aa49-98 placed N-terminal to aa7-28. (Numbering corresponds to HPV 16 E7 (SEQ ID NO:42)). The region of aa7-28 was selected as it includes CD8/CD4 epitope regions. The region of aa49-98 was selected as it included a complete structural domain, and CD8/CD4 epitope regions. While the HPV E7 protein also contains a central CD8 region, this is not well conserved.

The aa49-98 fragment was placed N-terminal in each E7 construct because the C-terminal of the HPV E7 protein folds autonomously into a well-structured domain. The hypothesis is that if a modified protein is folded similarly to the native protein, the modified protein will be processed by proteasomes in a manner similar to the native protein. Thus these HPV E7 peptides were constructed to contain an initial fragment of E7 which might be folded correctly, followed by a fragment (aa7-28) containing T-cell epitopes.

Amino acid substitutions included in the E7 construct are: C24G, E26Q (numbering corresponds to HPV 16 E7 (SEQ ID NO:42)). See SEQ ID NO: 61 (HPV16 E7 construct), SEQ ID NO:62 (HPV18 E7 construct).

The nucleotide constructs of Table 11A, 11B and 11C were made, encoding the identified conserved sequences (modified as indicated). Initial methionine residues were added to some constructs, and are included in the sequence listing. "Gly" indicates a nucleotide sequence encoding a 5×Gly linker (SEQ ID NO:48) was placed between adjacent HPV-encoding sequences in the construct. "2A" indicates a nucleotide sequence (SEQ ID NO:46) encoding a 2A 'ribosome skipping' sequence (SEQ ID NO:47) was placed between adjacent HPV-encoding sequences in the construct. The 2A sequence results in ribosomes releasing the translated sequence and initiating a new translation. The presence of the Glycine (5×Gly) resulted in expression of a polyprotein. The presence of the 2A sequence resulted in expression of separate HPV sequences, containing some additional 2A amino acids as described herein. These constructs are shown schematically in FIG. 14(*a*)-(*e*).

TABLE 11A

| Construct[1] | E1 | E2 | E6 | E7 |
|---|---|---|---|---|
| Gly_E2[3]E6[5]E1[2]E7[2] | HPV16 (SEQ ID NO: 51) | HPV16 (SEQ ID NO: 53) | HPV16 (SEQ ID NO: 56) | HPV 16 (SEQ ID NO: 61) |
| FIG. 14(a) | HPV18 (SEQ ID NO: 52) | HPV18 (SEQ ID NO: 54) | HPV18 (SEQ ID NO: 57) | HPV18 (SEQ ID NO: 62) |
| (SEQ ID NO: 63) | | HPV51 (SEQ ID NO: 55) | HPV58 (SEQ ID NO: 58) | |
| | | | HPV56 (SEQ ID NO: 59) | |
| | | | HPV73 (SEQ ID NO: 60) | |

(1) superscript numbers in construct identifiers indicate the number of HPV types; "Gly" indicates a 5×Gly linker was placed between HPV antigenic peptides in the construct.

TABLE 11B

Figure 14:
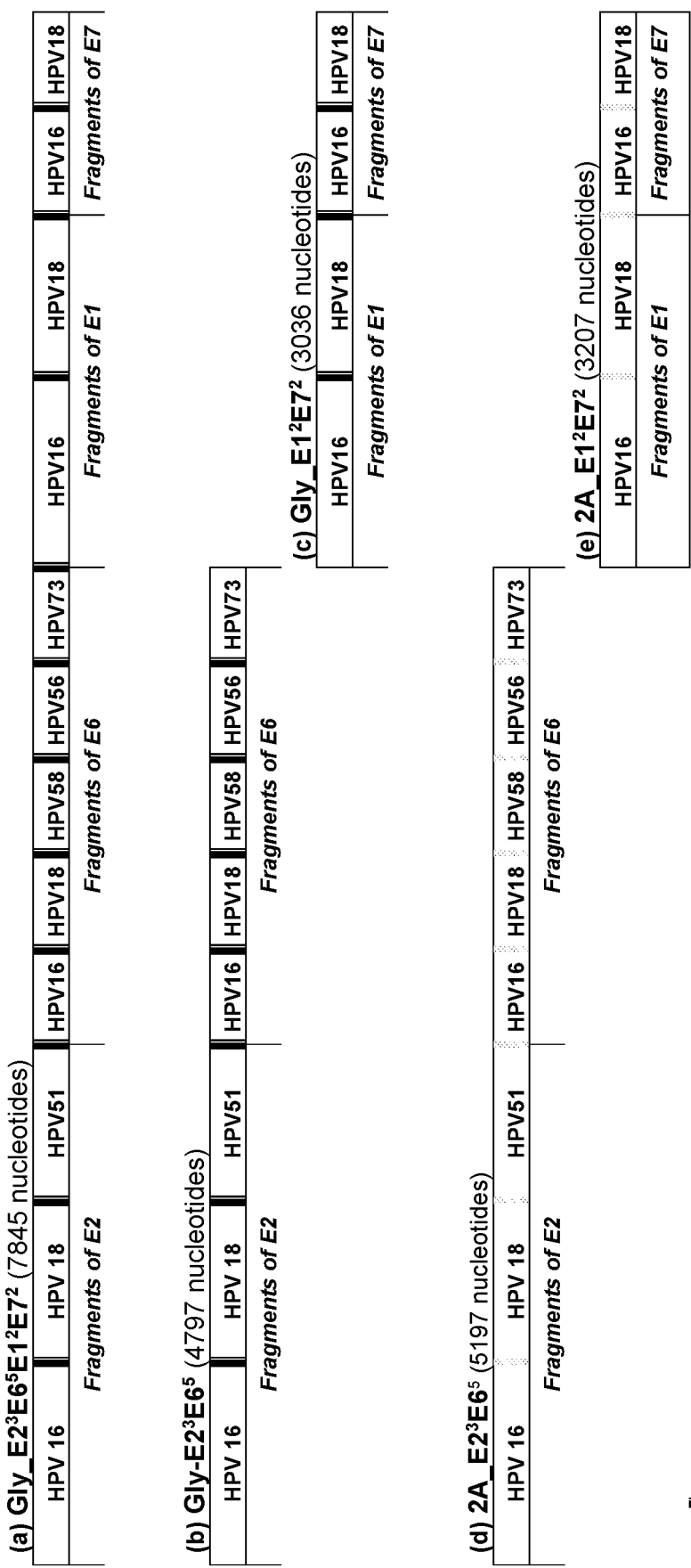
FIG. 14 diagrams nucleotide insert constructs (a) Gly_E2$^3$E6$^5$E1$^2$E7$^2$, (b) Gly-E2$^3$E6$^5$ (c) Gly_E1$^2$E7$^2$, (d) 2A_E2$^3$E6$^5$, and (e) 2A_E1$^2$E7$^2$. (Fragments of HPV proteins are not drawn to scale).

| Construct[1] | E2 | E6 |
|---|---|---|
| Gly_E2³E6⁵ FIG. 14(b) (SEQ ID NO: 64) | HPV16 (SEQ ID NO: 53) HPV18 (SEQ ID NO: 54) HPV51 (SEQ ID NO: 55) | HPV16 (SEQ ID NO: 56) HPV18 (SEQ ID NO: 57) HPV58 (SEQ ID NO: 58) HPV56 (SEQ ID NO: 59) HPV73 (SEQ ID NO: 60) |
| 2A_E2³E6⁵ FIG. 14(d) (SEQ ID NO: 66) | HPV16 (SEQ ID NO: 53) HPV18 (SEQ ID NO: 54) HPV51 (SEQ ID NO: 55) | HPV16 (SEQ ID NO: 56) HPV18 (SEQ ID NO: 57) HPV58 (SEQ ID NO: 58) HPV56 (SEQ ID NO: 59) HPV73 (SEQ ID NO: 60) |

[1]superscript numbers in construct identifiers indicate the number of HPV types; "Gly" indicates a 5xGly linker was placed between HPV antigenic peptides in the construct; "2A" indicates a 2A sequence was placed between HPV antigenic peptides in the construct.

TABLE 11C

| Construct[1] | E1 | E7 |
|---|---|---|
| Gly_E1²E7² FIG. 14(c) (SEQ ID NO: 65) | HPV16 (SEQ ID NO: 51) HPV18 (SEQ ID NO: 52) | HPV16 (SEQ ID NO: 61) HPV18 (SEQ ID NO: 62) |
| 2A_E1²E7² FIG. 14(e) (SEQ ID NO: 67) | HPV16 (SEQ ID NO: 51) HPV18 (SEQ ID NO: 52) | HPV16 (SEQ ID NO: 61) HPV18 (SEQ ID NO: 62) |

[1]superscript numbers in construct identifiers indicate the number of HPV types; "Gly" indicates a 5xGly linker was placed between HPV antigenic peptides in the construct; "2A" indicates a 2A sequence was placed between HPV antigenic peptides in the construct.

Example 10: Immunogenicity of Antigens Designed to Target 15 hrHPV Types

Construct designs selected from those described in Example 9 were introduced into ChAd155 vectors, and immunogenicity was assessed in a mouse model. Mice were immunized (intramuscular, 50 µl, 10⁹ total Viral Particles (VP)/dose/construct) at Day 0 and at Day 21, with one or two adenoviral constructs as shown below; when two adenoviral constructs were administered, they were formulated in the same buffer and co-administered at the same approximate anatomic site, at the same time. Medium (RPMI 1640 media supplemented with glutamine, penicillin/streptomycin, sodium pyruvate, non-essential amino acids, 2-mercaptoethanol, 5% FCS) was used as a negative control stimulation.

TABLE 12

HLA-A2/DR Mice: 6-8 week old females

| | Administered: |
|---|---|
| Group 1 N = 12 | Gly_E2³E6⁵E1²E7² (SEQ ID NO: 63) |
| Group 2* N = 12 | Gly_E2³E6⁵ (SEQ ID NO: 64) and Gly_E1²E7² (SEQ ID NO: 65) |
| Group 3* N = 12 | 2A_E2³E6⁵ (SEQ ID NO: 66) and 2A_E1²E7² (SEQ ID NO: 67) |
| Group 4 (control) N = 6 | NaCl 150 mM |

Specific CD4+ and CD8+ T cell response assessed using HPV16 and HPV18 E1, E2 and E6 peptide pools*, plus HPV16 E7 and HPV18 E7 peptide pools, plus medium; Cross Reactive CD4+ and CD8+ T cell response assessed using HPV35 E1, E2 and E6 peptide pool*; Specific HPV35 E1 and E2 peptide pool including only (CD8 enriched regions).
*peptide pools covered only the region of HPV protein contained in the constructs, and did not cover the entire HPV protein.

Twenty-one days after the second immunization, mice were humanely euthanized and spleen and blood samples collected. Specific and cross-reactive CD4+ and CD8+ T cell responses were assessed using pools of peptides, as described above. HPV16 and HPV18 E1, E2, E6 peptide pools, plus peptides comprising HPV35 E1 CD8 epitopes or HPV35 E2 CD8 epitopes, were used to assess T cell response. Responses are summarized in Table 13, below, as +/−(median response 0.1-0.5%), +(median response between 0.5-1%), ++(median response between 1-2%), and +++(median response>2%).

TABLE 13

| HPV type | HPV Early Protein Antigen | | | | | | | |
|---|---|---|---|---|---|---|---|---|
| | E1 | | E2 | | E6 | | E7 | |
| | CD4 | CD8 | CD4 | CD8 | CD4 | CD8 | CD4 | CD8 |
| HPV16 Specific | +/− | ++ | − | − | − | − | IR | IR |
| HPV18 Specific | +/− | +++ | − | − | − | − | IR | IR |
| HPV35 Cross | − | ++ | − | − | − | − | IR | IR |

IR = inconclusive result due to conflicting data obtained following stimulation with protein or pool of peptides.

Example 11: Antigen Design to Target 7 hrHPV Types

Investigations were carried out to identify HPV antigens capable of eliciting an immunogenic response to at least seven of fifteen high risk HPV types, and to prepare adenoviral constructs capable of expressing the antigens. The amino acid sequences of E1, E2, E6 and E7 proteins from fifteen hrHPV types were compared, and regions of high similarity that contained CD4/CD8 epitopes were identified. Antigenic regions were selected to target seven hrHPV types: 16, 18, 31, 33, 45, 52, and 58.

Table 14 and Table 15 illustrate that, for each of the proteins studied, combinations of conserved sequences from certain HPV types provided a minimum 70% identity or 70% similarity to other HPV types (for that protein). In Tables 14 and 15, for each protein (E1, E2, E6 or E7), squares marked with an 'X' indicate the HPV type from which a sequence was selected; the percent identity or similarity to other HPV types that is provided by the selected sequences is indicated in the other squares of the column (blank squares indicate less than 70% similarity or identity; n/d indicates not done).

TABLE 14

Identity Threshold 70%

|  | E1 | E2 | E6 | E7 |
|---|---|---|---|---|
| HPV16 | X | X | X | X |
| HPV18 | X | X | X | X |
| HPV31 | 79% | X | X | 72% |
| HPV33 | X | X | X |  |
| HPV45 | 89% | X | X | 78% |
| HPV52 | 79% | X | X |  |
| HPV58 | 90% | X | X |  |
| HPV56 |  |  |  |  |
| HPV51 |  |  |  |  |
| HPV39 | 80% |  |  |  |
| HPV35 | 78% | 73% | 72% | 72% |
| HPV59 | 81% |  |  |  |
| HPV68 | 80% |  |  |  |
| HPV73 |  |  |  |  |
| HPV82 |  |  |  |  |

TABLE 15

Similarity Threshold 70%

| E1 | E2 | E6 | E7 |
|---|---|---|---|
| X | X | X | X |
| X | X | X | X |
| 90% | X | X | n/d |
| X | X | X | n/d |
| 95% | X | X | n/d |
| 92% | X | X | n/d |
| 96% | X | X | n/d |
| 81% |  | 73% | n/d |
| 80% |  | 74% | n/d |
| 89% | 74% | 78% | n/d |
| 90% | 81% | 81% | n/d |
| 93% | 76% | 76% | n/d |
| 90% | 74% | 79% | n/d |
| 83% | 71% | 74% | n/d |
| 79% |  | 72% | n/d |

E1=aa203-622:

The E1 constructs from HPV 16, 18 and 33 contained aa203-622, (numbering corresponds to full length HPV 16 E1 (SEQ ID NO:39)). See SEQ ID NO:68 (HPV16 E1 construct), SEQ ID NO:69 (HPV18 E1 construct), SEQ ID NO:70 (HPV33 E1 construct).

E2=aa1-201+GGTGGS+aa285-365:

The E2 constructs from HPV 16, 18, 31, 33, 45, 52 and 58 contained a TAD segment (amino acids corresponding to aa1-201 of full-length HPV16 E2 (SEQ ID NO:40)), a GGTGGS linker, and a DBD domain segment (amino acids corresponding to aa285-365 of full-length HPV16 E2 (SEQ ID NO:40). See SEQ ID NO:71 (HPV16 E2 construct), SEQ ID NO: 72 (HPV18 E2 construct), SEQ ID NO:73 (HPV31 E2 construct), SEQ ID NO:74 (HPV33 E2 construct), SEQ ID NO:75 (HPV45 E2 construct), SEQ ID NO:76 (HPV52 E2 construct), and SEQ ID NO:77 (HPV58 E2 construct).

E6=aa11-150:

The E6 constructs from HPV 16, 18, 31, 33, 45, 52 and 58 contained amino acids 11-150 (numbering based on HPV16 E6 full length, SEQ ID NO:41). See SEQ ID NO:78 (HPV16 E6 construct), SEQ ID NO:79 (HPV18 E6 construct), SEQ ID NO:80 (HPV31 E6 construct), SEQ ID NO:81 (HPV33 E6 construct), SEQ ID NO:82 (HPV45 E6 construct), SEQ ID NO:83 (HPV52 E6 construct), and SEQ ID NO:84 (HPV58 E6 construct).

E7=aa49-98 and aa7-28, with Fragment aa49-98 Placed N-Terminal to aa7-28, +C24G and E26Q Substitutions:

The E7 constructs from HPV 16 and 18 have the same sequence as described in Example 9, above (SEQ ID NO: 61 and SEQ ID NO:62, respectively).

Figure 15:
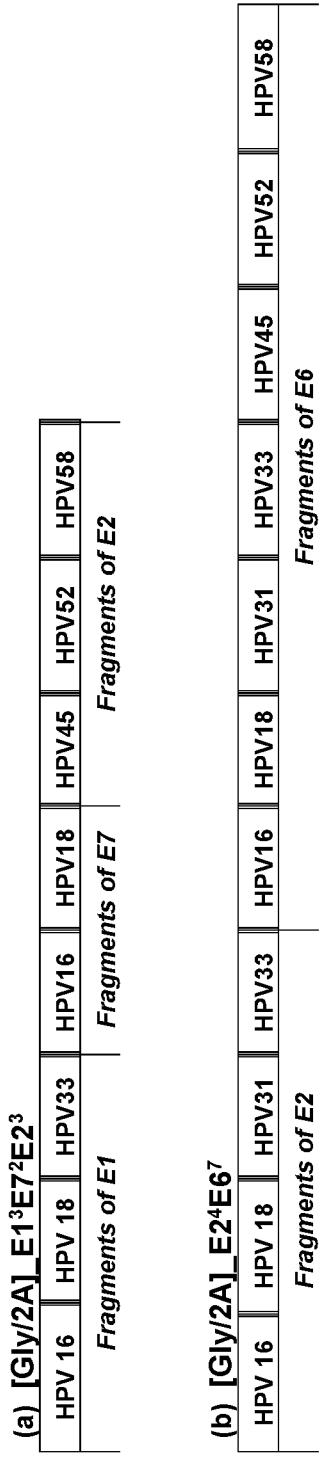
FIG. 15 diagrams nucleotide insert constructs (a) [2A/Gly]_E1$^3$E7$^2$E2$^3$, and (b) [2A/Gly]_E2$^4$E6$^7$. Double lines indicate the position of the 5×Gly or 2A sequence. (Fragments of HPV proteins are not drawn to scale). "2A/Gly" indicates the presence of either the 2A sequence or the 5×Gly linker.

Eight nucleotide constructs were made as shown in Tables 16A and 16B, where "Gly" indicates that a nucleotide sequence encoding a 5×Gly linker (SEQ ID NO:48) was placed between adjacent HPV-encoding sequences in the construct. "2A" indicates that a 2A nucleotide sequence (SEQ ID NO:46) was placed between adjacent HPV-encoding sequences in the construct. As above, initial methionine residues were added to constructs where the N-terminal HPV segment did not contain an initial methionine (E1³E7²E2³). These constructs are shown schematically in FIG. 15(a)-(b), where the triple vertical lines indicate the presence of either the 5×Gly linker or 2A sequence (depending on the construct).

TABLE 16A

| E1E7E2 construct | | | |
|---|---|---|---|
| Construct Identifier[1] | E1 | E2 | E7 |
| Gly_ E1³E7²E2³ | HPV16 (SEQ ID NO: 68) | HPV45 (SEQ ID NO: 75) | HPV16 (SEQ ID NO: 61) |
| SEQ ID NO: 85 | HPV18 (SEQ ID NO: 69) | HPV52 (SEQ ID NO: 76) | HPV18 (SEQ ID NO: 62) |
| FIG. 15(a) | HPV33 (SEQ ID NO: 70) | HPV58 (SEQ ID NO: 77) | |
| 2A_E1³E7²E2³ | HPV16 (SEQ ID NO: 68) | HPV45 (SEQ ID NO: 75) | HPV16 (SEQ ID NO: 61) |
| SEQ ID NO: 86 | HPV18 (SEQ ID NO: 69) | HPV52 (SEQ ID NO: 76) | HPV18 (SEQ ID NO: 62) |
| FIG. 15(a) | HPV33 (SEQ ID NO: 70) | HPV58 (SEQ ID NO: 77) | |

(1) superscript numbers in construct identifiers indicate the number of HPV types; "Gly" indicates a 5×Gly linker was placed between HPV antigenic peptides in the construcy; "2A" indicates a 2A sequence was placed between HPV antigenic peptides in the construct.

TABLE 16B

E2E6 construct

| Construct Identifier[1] | E2 | E6 |
|---|---|---|
| Gly_E2[4]E6[7] SEQ ID NO: 87 FIG. 15(b) | HPV16 (SEQ ID NO: 71) HPV18 (SEQ ID NO: 72) HPV31 (SEQ ID NO: 73) HPV33 (SEQ ID NO: 74) | HPV16 (SEQ ID NO: 78) HPV18 (SEQ ID NO: 79) HPV31 (SEQ ID NO: 80) HPV33 (SEQ ID NO: 81) HPV45 (SEQ ID NO: 82) HPV52 (SEQ ID NO: 83) HPV58 (SEQ ID NO: 84) |
| 2A_E24E67 SEQ ID NO: 88 FIG. 15(b) | HPV16 (SEQ ID NO: 71) HPV18 (SEQ ID NO: 72) HPV31 (SEQ ID NO: 73) HPV33 (SEQ ID NO: 74) | HPV16 (SEQ ID NO: 78) HPV18 (SEQ ID NO: 79) HPV31 (SEQ ID NO: 80) HPV33 (SEQ ID NO: 81) HPV45 (SEQ ID NO: 82) HPV52 (SEQ ID NO: 83) HPV58 (SEQ ID NO: 84) |

[1]superscript numbers in construct identifiers indicate the number of HPV types; "Gly" indicates a 5xGly linker was placed between HPV antigenic peptides in the construct; "2A" indicates a 2A sequence was placed between HPV antigenic peptides in the construct.

These constructs could additionally be modified to comprise amino acid substitutions designed to eliminate the native activity of the wild-type E1, E2, E6 and E7 proteins, as discussed above. In the E1 protein, potential substitutions include (all amino acid numbering correlates to HPV16 E1) K285A, F392A, and G482D. In the E2 protein, potential substitutions include E39A, K111A, K306E+K307E, and D338A+E340D+W341A+D344A. In protein E6, potential substitutions include F54R and C110R. In protein E7, potential substitutions include C24G, E26Q, L67R, L82R+L84R, and C91G.

Mutated versions of the Gly_E1[3]E7[2]E2[3] (SEQ ID NO:132) and Gly_E2[4]E6[7] (SEQ ID NO:133) constructs shown in tables 16A and B and FIGS. 15A and B were prepared with the following mutations:

E1=203-622+mut G482D;

E2=1-201+GGTGGS+285-365+mut K111A;

E6=11-150+mut C110R and mut F54R;

E7 HPV16=49-98+7-28+mutations C24G and E26Q/E7 HPV18=58-105+7-42+mutations C27G and E29Q.

Example 12: Alternative Antigen Design to Target 7 hrHPV Types ("Approach 2")

The amino acid sequences of E1, E2, E6 and E7 proteins from fifteen hrHPV types were compared, and regions of high similarity, and that contained CD4/CD8 epitopes, were identified. Antigenic regions were selected to target seven hrHPV types: 16, 18, 31, 33, 45, 52, and 58.

The present antigen design (compared to Example 11, above), includes fewer E2 and E6 antigenic sequences, but additional HPV31 E1 and HPV45 E1 sequences (described below). Table 17 and Table 18 illustrate the HPV source of selected sequences for each of the early proteins, and the coverage provided for other HPV types.

TABLE 17

Identity Threshold 70%

|  | E1 | E2 | E6 | E7 |
|---|---|---|---|---|
| HPV16 | X | X | X | X |
| HPV18 | X | X | X | X |
| HPV31 | X | 71% | X | 72% |
| HPV33 | X | X | 85% |  |
| HPV45 | X | 77% | X | 78% |
| HPV52 | 79% | X | X |  |
| HPV58 | 90% | 80% | X |  |
| HPV56 |  |  |  |  |
| HPV51 |  |  |  |  |
| HPV39 | 81% |  |  |  |
| HPV35 | 81% |  | 72% | 76% |
| HPV59 | 81% |  |  |  |
| HPV68 | 81% |  |  |  |
| HPV73 |  |  |  |  |
| HPV82 |  |  |  |  |

TABLE 18

Similarity Threshold 70%

| E1 | E2 | E6 | E7 |
|---|---|---|---|
| X | X | X | X |
| X | X | X | X |
| X | 81% | X | n/d |
| X | x | 92% | n/d |
| X | 88% | X | n/d |
| 92% | X | X | n/d |
| 96% | 89% | X | n/d |
| 81% |  | 73% | n/d |
| 81% |  | 74% | n/d |
| 90% | 74% | 78% | n/d |
| 90% | 81% | 81% | n/d |
| 93% | 76% | 76% | n/d |
| 91% | 74% | 79% | n/d |
| 83% | 71% | 74% | n/d |
| 80% |  | 72% | n/d |

E1=aa203-622:

The E1 constructs from HPV 16, 18 and 33 were the same as described above, in Example 11; see SEQ ID NO:68 (HPV16 E1 construct), SEQ ID NO:69 (HPV18 E1 construct), SEQ ID NO:70 (HPV33 E1 construct).

The E1 constructs from HPV31 and HPV45 contained aa203-622 (numbering corresponds to full length HPV 16 E1 (SEQ ID NO:39)). See SEQ ID NO:89 (HPV31 E1 construct) and SEQ ID NO:90 (HPV45 E1 construct).

Figure 16:
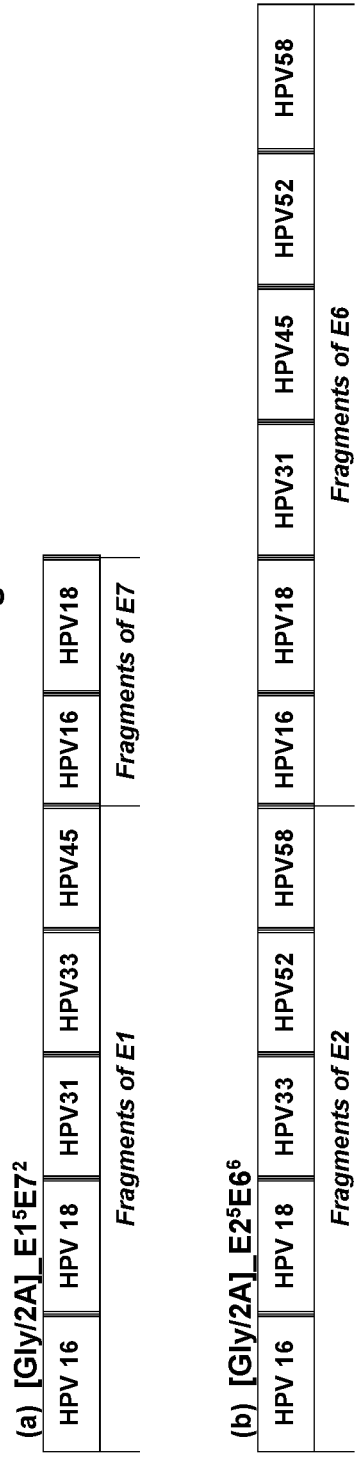
FIG. 16 diagrams nucleotide insert constructs (a) [2A/Gly]_E1$^5$E7$^2$, and (b) [2A/Gly]_E2$^5$E6$^6$. (Fragments of HPV proteins are not drawn to scale).

Four nucleotide constructs as shown in Table 19A and 19B were made, where "Gly" indicates that a nucleotide sequence encoding a 5×Gly linker (SEQ ID NO:48) was placed between adjacent HPV-encoding sequences in the construct. "2A" indicates that a 2A nucleotide sequence (SEQ ID NO:46) was placed between adjacent HPV-encoding sequences in the construct. These constructs are shown schematically in FIG. 16(a)-(b), where the triple vertical lines indicate either a 5×Gly linker, or the 2A sequence (depending on the construct). The E1$^5$E7$^2$ nucleotide sequences also encoded an initial methionine residue, in addition to the HPV amino acid sequences.

These constructs could additionally be modified to comprise amino acid substitutions designed to eliminate the native activity of the wild-type E1, E2, E6 and E7 proteins, as discussed above. In the E1 protein, potential substitutions include (all amino acid numbering correlates to HPV16 E1) K285A, F392A, and G482D. In the E2 protein, potential substitutions include E39A, K111A, K306E+K307E, and D338A+E340D+W341A+D344A. In protein E6, potential substitutions include F54R and C110R. In protein E7, potential substitutions include C24G, E26Q, L67R, L82R+L84R, and C91G.

TABLE 19A

| Construct Identifier[1] | E1 | E7 |
|---|---|---|
| Gly_E1$^5$E7$^2$ SEQ ID NO: 91 FIG. 16(a) | HPV16 (SEQ ID NO: 68) HPV18 (SEQ ID NO: 69) HPV31 (SEQ ID NO: 89) HPV33 (SEQ ID NO: 70) HPV45 (SEQ ID NO: 90) | HPV16 (SEQ ID NO: 61) HPV18 (SEQ ID NO: 62) |
| 2A_E1$^5$E7$^2$ SEQ ID NO: 92 FIG. 16(a) | HPV16 (SEQ ID NO: 68) HPV18 (SEQ ID NO: 69) HPV31 (SEQ ID NO: 89) HPV33 (SEQ ID NO: 70) HPV45 (SEQ ID NO: 90) | HPV16 (SEQ ID NO: 61) HPV18 (SEQ ID NO: 62) |

[1] superscript numbers in construct identifiers indicate the number of HPV types; "Gly" indicates a 5xGly linker was placed between HPV antigenic peptides in the construct; "2A" indicates a 2A sequence was placed between HPV antigenic peptides in the construct.

TABLE 19B

E2E6 construct

| Construct Identifier[1] | E2 | E6 |
|---|---|---|
| Gly_E2$^5$E6$^6$ SEQ ID NO: 93 FIG. 16(b) | HPV16 (SEQ ID NO: 71) HPV18 (SEQ ID NO: 72) HPV33 (SEQ ID NO: 74) HPV52 (SEQ ID NO: 76) HPV58 (SEQ ID NO: 77) | HPV16 (SEQ ID NO: 78) HPV18 (SEQ ID NO: 79) HPV31 (SEQ ID NO: 80) HPV45 (SEQ ID NO: 82) HPV52 (SEQ ID NO: 83) HPV58 (SEQ ID NO: 84) |
| 2A_E2$^5$E6$^6$ SEQ ID NO: 94 FIG. 16(b) | HPV16 (SEQ ID NO: 71) HPV18 (SEQ ID NO: 72) HPV33 (SEQ ID NO: 74) HPV52 (SEQ ID NO: 76) HPV58 (SEQ ID NO: 77) | HPV16 (SEQ ID NO: 78) HPV18 (SEQ ID NO: 79) HPV31 (SEQ ID NO: 80) HPV45 (SEQ ID NO: 82) HPV52 (SEQ ID NO: 83) HPV58 (SEQ ID NO: 84) |

[1] superscript numbers in construct identifiers indicate the number of HPV types; "Gly" indicates a 5xGly linker was placed between HPV antigenic peptides in the construct; "2A" indicates a 2A sequence was placed between HPV antigenic peptides in the construct.

Example 13: Immunogenicity in Mouse Models—Materials and Methods

The immunogenicity of ChAd155 constructs selected from those described above was assessed in mouse models. The mouse strains used were CB6/F1, HLA A2/DR1 transgenic (tg), and CD-1. Groups of mice were immunized (intramuscular injection, 50 µl, $10^9$ total Viral Particles/dose/adeno construct) with the adenoviral construct(s) as shown in TABLE 20, first at Day 0 and again at about Day 21. Negative control groups received intramuscular injections of 50 µl NaCl 150 mM administered on days 0 and 21.

TABLE 20

| | Viral Vector Constructs | Immunization (VP/construct/dose) |
|---|---|---|
| Group 1 | ChAd155- Gly_$E2^3E6^5E1^2E7^2$ (SEQ ID NO: 63) | $10^9$ |
| Group 2* | ChAd155 - Gly_$E1^2E7^2$ + ChAd155 - Gly-$E2^3E6^5$ (SEQ ID Nos: 64 and 65) | $10^9$ |
| Group 3* | ChAd155 -2A_$E1^2E7^2$ + ChAd155 -2A_$E2^3E6^5$ (SEQ ID Nos: 66 and 67) | $10^9$ |
| Group 4 | None (NaCl 150 mM control) | NA |

*co-administration of both adenoviral constructs on Days 0 and 21: $10^9$ VP of each ChAd155 construct in 50 µl total volume.

The specific constructs are shown graphically in FIGS. 14A-14E, and are referred to as Gly_$E2^3E6^5E1^2E7^2$ (FIG. 14A, SEQ ID NO:63), Gly_$E2^3E6^5$ (FIG. 14B, SEQ ID NO:64), Gly_$E1^2E7^2$ (FIG. 14C, SEQ ID NO:65), 2A_$E2^3E6^5$ (FIG. 14D, SEQ ID NO:66), and 2A_$E1^2E7^2$ (FIG. 14E, SEQ ID NO:67). The ChAd155 viral vector ChAd155 ΔE1ΔE3ΔE4+Ad5E4orf6 was utilized; the encoded HPV E1, E2, E6 and E7 sequences were:

HPV16E1 (SEQ ID NO:51) and HPV18E1 (SEQ ID NO:52): amino acids 203-622 with substitution G482D (numbering corresponds to HPV 16 full-length E1 sequence (SEQ ID NO:39)).

HPV16E2 (SEQ ID NO:53), HPV18E2 (SEQ ID NO:54), and HPV51E2 (SEQ ID NO:55) amino acids 1-201+GGTGGS+aa285-365 with substitution K111A (numbering corresponds to HPV 16 full-length E2 sequence (SEQ ID NO:40)).

HPV16E6 (SEQ ID NO: 56), HPV18E6 (SEQ ID NO: 57), HPV58 E6 (SEQ ID NO: 58), HPV56E6 (SEQ ID NO: 59), and HPV73E6 (SEQ ID NO: 60): amino acids 11-150 with substitution F54R and C110R (numbering corresponds to HPV 16 full-length E6 sequence (SEQ ID NO:41)).

HPV16E7 (SEQ ID NO:61) and HPV18E7 (SEQ ID NO:62): amino acids 49-98+7-28 aa with substitution C24G and E26Q (numbering corresponds to HPV 16 full-length E7 sequence (SEQ ID NO:42)).

The amino acid substitution(s) ('mutations') as described above were utilized to inhibit the protein activity. See also TABLE 11A, 11B and 11C herein.

The ChAd155-HPV constructs were designed with either glycine spacers (causing the HPV inserted sequences to be expressed as a polyprotein) or with 2A sites (causing the HPV inserted sequences to be expressed as individual polypeptides).

No adjuvant or adjuvant system was used in the present experiment.

CB6F1 Mouse Model:

CB6F1 mice (hybrid of C57Bl/6 and Balb/C mice) have been shown to generate potent CD4+/CD8+ T cell and humoral immune responses following vaccination with various immunogens, including adjuvanted proteins and viral vectors. The profile of the vaccine-induced immune response generated in CB6F1 mice compared to expected responses in humans may be impacted by some differences pertaining to TLR expression, HLA background, and antigen presentation. However, the capacity for inducing CD4+/CD8+ T immune responses has shown comparable trends between CB6F1 mice and humans.

As good reproducibility is expected using the inbred strain CB6F1 mice (compared to strains CD1 and HLA A2/DR1tg), eight CB6F1 mice per group were used in Groups 1 to 3, with six mice in Group 4 (control NaCl), for a total of 30 CB6F1 mice. Due to technical constraints (number of in vitro restimulations), these 30 CB6F1 mice were evaluated in two individual experiments as follows (statistical analysis was done on the compiled data set):

CB6F1 Experiment 1: four mice per test Group 1 to 3; three mice for Group 4.

CB6F1 Experiment 2: four mice per test Groups 1 to 3; three mice for Group 4.

HLA A2/DR1 Transgenic (Tg) Mouse Model:

In this model, mouse MHC have been knocked out and replaced by Human MHC class I HLA-A2 and MHC class II HLA-DR1 (which are common alleles in the human Caucasian population). Antigen is presented in a human HLA context without interference with mouse MHC (see e.g., Pajot et al., EUR. J. Immunol. 2004 34: 3060-3069).

Twelve HLA A2/DR1 tg mice were used per group, for test Groups 1 to 3; six mice were used for Group 4 (NaCl control), for a total of 42 HLA A2/DR1tg mice. For technical constraints (number of in vitro re-stimulations), these 42 HLA A2/DR1 mice were evaluated in three individual experiments (statistical analysis was done on the compiled data set):

HLA A2/DR1 tg Experiment 1: four mice per test Group 1 to 3; two mice for Group 4.

HLA A2/DR1 tg Experiment 2: four mice per test Group 1 to 3; two mice for Group 4.

HLA A2/DR1 tg Experiment 3: four mice per test Group 1 to 3; two mice for Group 4.

CD-1 Mouse Model:

The use of the outbred CD-1 mouse model addresses individual variability. These mice present antigens in the context of various MHC class I and class II, leading to broader responses compared to inbred mice. Twelve CD-1 mice were used per group, for Groups 1 to 3; and four mice for Group 4 (NaCl control), for a total of 40 CD1 mice. For technical constraints (number of in vitro restimulations), these 40 CD-1 mice were evaluated in two experiments (statistical analysis was done on the compiled data set):

CD-1 Experiment 1: six mice per test Groups 1 to 3; two mice for Group 4.

CD-1 Experiment 2: six mice per test Groups 1 to 3; two mice for Group 4.

Experimental Design:

For each mouse model (CB6F1, HLA A2/DR1 transgenic, and CD-1), mice were randomly assigned to the study groups, and mice were 6-8 weeks old at study start. Mice in Groups 1-3 were intramuscularly immunized twice (at days 0 and 21, in the gastrocnemius muscle) with the ChAd155-HPV constructs as shown in TABLE 20. Mice in control Group 4 received two intramuscular injections of NaCl 150 mM (administered days 0 and 21, in the gastrocnemius muscle).

Twenty-one days after the second immunization (Day 42), mice were humanely euthanized, spleen and blood samples were collected, and CD4+ and CD8+ T cell responses were assessed by Intracellular Cytokine Staining (ICS) as described below.

Intracellular Cytokine Staining (ICS)

The frequencies of HPV-specific CD4+ and CD8+ T-cells producing IL-2, IFN-γ and/or TNF-α were evaluated by ICS in spleen cells collected at Day 42.

Spleens were collected in GIBCO™ RPMI 1640 medium (ThermoFisher Scientific), without L-glutamine, supplemented with RPMI additives (referred to herein as RPMI medium). Spleens were dissociated in a single-cell suspension which was transferred on a 100 µm cell strainer and rinsed with 5 ml of the RPMI medium. Spleen cells were then centrifuged at 335 g for 10 min (4° C.) and the pellet was re-suspended in 4 ml of RPMI medium. This rinsing step was repeated one more time and the final pellet was re-suspended in 5 ml of RPMI medium supplemented with 5% Fetal Calf Serum (FCS). Cell suspension was then diluted 20× (10 µl) in Phosphate Buffered Saline (PBS buffer) (190 µl) for cell counting (using MACSQUANT™ Analyzer). After counting, cells were centrifuged again (335 g, 10 min, Room Temperature (RT)) and the cell pellet was re-suspended at $10^7$ cells/ml in RPMI medium.

Splenocytes were seeded in round bottom 96-well plates at approximately 1 million cells per well. Each sample was tested in triplicate to have sufficient CD8 T cells (>5000 events). In-vitro stimulation used 100 µl of a peptide pool (see TABLE 21 and TABLE 22), or 100 µl of a $PD^{1/3}$-HPV fusion protein (see TABLE 22). The $PD^{1/3}$-HPV16 E7 and $PD^{1/3}$-HPV18 E7 fusion proteins comprised a 109 amino acid fragment of *Haemophilus influenzae* Protein D (SEQ ID NO:97) (an N-terminal fragment of the Protein D sequence, omitting the signal sequence).

Phorbol Myristate Acetate (PMA, Sigma-Aldrich)+ionomycin (Sigma-Aldrich) solution at working concentrations of 0.25 µg/ml and 2.5 µg/ml, respectively, was used as positive control.

TABLE 21 polypeptides for in vitro stimulation

| HPV type | HPV protein | Peptide pools used for in vitro stimulation of splenocytes: |
|---|---|---|
| HPV16 | E1 E2 E6 E7 | pool of 15mer peptides overlapping by 11aa, covering full-length sequence of the selected HPV16 protein; at a working concentration of 1 µg/ml per peptide. |
| HPV18 | E1 E2 E6 E7 | pool of 15mer peptides overlapping by 11aa, covering full-length sequence of the selected HPV18 protein; at a working concentration of 1 µg/ml per peptide. |
| HPV33 | E1 E2 E6 | pool of 15mer peptides overlapping by 11aa covering the antigen-designed amino acid sequence of the selected HPV33 protein (E1 = SEQ ID NO: 70, E2 = SEQ ID NO: 103, E6 = SEQ ID NO: 81); at a working concentration of 1 µg/ml per peptide. |
| HPV35 | E1 E2 E6 | pool of 15mer peptides overlapping by 11aa covering the antigen-designed amino acid sequence of the selected HPV35 protein (E1 = SEQ ID NO: 98, E2 = SEQ ID NO: 102, E6 = SEQ ID NO: 99); at a working concentration of 1 µg/ml per peptide. |
| | E7 | pool of 15mer peptides overlapping by 11aa, covering full-length sequence of HPV35 E7; at a working concentration of 1 µg/ml per peptide. |
| HPV45 | E1 E2 E6 | pool of 15mer peptides overlapping by 11aa covering the antigen-designed amino acid sequence of the selected HPV45 protein (E1 = SEQ ID NO: 90, E2 = SEQ ID NO: 101. E6 = SEQ ID NO: 82); at a working concentration of 1 µg/ml per peptide. |

TABLE 22 additional polypeptides for in vitro stimulation in HLA 2/DR1 tg model

| HPV type | HPV protein | polypeptides used for in vitro stimulation of splenocytes: |
|---|---|---|
| HPV16 | E7 | $PD^{1/3}$ - HPV16 E7 fusion protein; working concentration of 10 ug/ml. |
| HPV18 | E7 | $PD^{1/3}$ - HPV18 E7 fusion protein; working concentration of 8 ug/ml. |
| HPV35 | E1 E2 | pool of 15mer peptides overlapping by 11aa covering the predictive human CD8 T cell epitope-enriched regions of the selected HPV35 protein (E1 = SEQ ID NO: 107. E2 = SEQ ID NO: 112); working concentration 1 µg/ml per peptide |

For in-vitro stimulation using pools of HPV peptides: anti-mouse CD49d and anti-mouse CD28 antibodies (1 µg/ml; both from Becton Dickinson) were added and cells were further incubated for two hours at 37° C., followed by 4 hours incubation in presence of Brefeldin A (1 µg/ml; Becton Dickinson) to inhibit cytokine secretion. For in-vitro stimulation using $PD^{1/3}$-HPV16 and $PD^{1/3}$-HPV18 E7 proteins: anti-mouse CD49d and anti-mouse CD28 antibodies (1 µg/ml; both from Becton Dickinson) were added and cells were further incubated for 16 hours at 37° C., followed by 4 hours incubation in presence of Brefeldin A (1 µg/ml; Becton Dickinson) to inhibit cytokine secretion.

Cell staining was performed as follows: cell suspensions were placed in v-bottom 96 well plates, pelleted (150 g, 5 min at 4° C.), and washed in 250 µl PBS 1% FCS. Cells were pelleted again and re-suspended in 50 µl of PBS 1% FCS containing 2% Fc blocking reagent (1/50 dilution; anti-mouse CD16/32 antibodies (Becton Dickinson)). After 10 min incubation at 4° C., 50 µl of a mixture of anti-mouse CD4-V450 (1/200 dilution; (Becton Dickinson)), anti-mouse CD8 PERCP-CY™ 5.5 (1/100 dilution; (Becton Dickinson)) and LIVE/DEAD™ fixable yellow dead cell stainfixable yellow dead cell stain (1/1000; Molecular Probes) was added and incubated 30 min in obscurity at 4° C. After a washing in PBS 1% FCS, cells were permeabilized in 200 µl of CYTOFIX/CYTOPERM™ (Becton Dickinson) and incubated 20 min at 4° C.

Cells were then washed with PERM/WASH™ (Becton Dickinson) and re-suspended with 50 µl of anti-IFNg allophycocyanin (APC, 1/200)+anti-IL-2 Fluorescein isothiocyanate (FITC, 1/400)+anti-TNFα phycoerythrin (PE) (1/700) diluted in PERM/WASH™. After 1 h incubation at 4° C., cells were washed with PERM/WASH™ and re-suspended in 220 µl PBS.

Stained cells were analyzed by flow cytometry using a BD LSR II flow cytometer and the FlowJo software (available from Stanford Shared FACS Facility). Live cells were identified with the LIVE/DEAD™ staining and then lymphocytes were isolated based on FSC/SSC (forward scatter/side scatter) gating. Cell acquisition was performed on ~20,000 events (CD4+ T-cells) and ~5,000 events (CD8+ T-cells). The percentages of IFN-γ, IL-2 and/or TNFα producing CD4+/CD8+ T cells were calculated from lymphocytes population based on CD4 T and CD8 T positive gated populations.

Example 14: CD8/CD4 T Cell Responses in CB6/F1 Mice

Using the materials and methods of Example 13, in vitro stimulation was carried out in the CB6/F1 mice using the peptide pools as described in TABLE 21. Specific responses were assessed using HPV16 and HPV18 peptide pools; cross reactivity was assessed using HPV33, HPV35 and HPV45 peptide pools.

Estimates of the geometric means and their 95% confidence intervals (CI) were calculated using back-transformation on log 10 values. For log transformations, values equal to 0 are set to 0.0001.

To assess the level of response, the posterior predictive probability to observe a new value above the 0.2% threshold, i.e. the activity threshold, was computed for each group. A non-informative prior was used to compute the joint posterior distributions of the mean and standard deviation. Based on the predictive probability of success, i.e. a new response>0.2%, the response was further categorized as negative (−), mild (+), moderate (++) or substantial (+++) based on the predictive probability falling into the [0, 25%], (25%, 50%], (50%, 75%] or (75%, 100%] intervals respectively.

For each mouse group (1, 2, 3 or 4), a table was generated displaying the mean and 95% CI (lower CL, upper CL) of each response; the posterior predictive distribution and the level of response was also generated (data not shown). Responses: CD4+ and CD8+responses to each of E1, E2, and E6 from each of HPV16, HPV18, HPV33, HPV35, and HPV45; CD4+ and CD8+responses to E7 from each of HPV16, HPV18, and HPV35.

Results from the experiment are summarized in TABLES 23 and 24 below, where the level of response (CD8/CD4) is displayed by group antigen and serotype. As described above, Group 1 was immunized with the ChAd155 $Gly\_E2^3E6^5E1^2E7^2$ construct; Group 2 was immunized by co-administration of two separate ChAd155 constructs ($Gly\_E1^2E7^2$ and $Gly\_E2^3E6^5$); Group 3 was immunized by co-administration of two separate ChAd155 constructs ($2A\_E1^2E7^2$ and $2A\_E2^3E6^5$); Group 4 received NaCl (negative control).

The levels of responses are defined as follows:
"+++" Prob(New response>0.2%|data)>75%
"++" Prob(New response>0.2%|data) in (50%, 75%]
"+" Prob(New response>0.2%|data) in (25%, 50%]
"−" Prob(New response>0.2%|data)<=25%

TABLE 23

| | CD8+ response in CB6/FI mice | | | | | |
|---|---|---|---|---|---|---|
| antigen | Group | HPV16 | HPV18 | HPV33 | HPV35 | HPV45 |
| E1 | 3 | +++ | +++ | + | +++ | +++ |
| E1 | 2 | +++ | +++ | ++ | +++ | +++ |
| E1 | 1 | +++ | +++ | − | +++ | +++ |
| E1 | 4 | − | − | − | − | − |
| E2 | 3 | − | − | − | − | − |
| E2 | 2 | − | − | − | − | − |
| E2 | 1 | − | − | − | − | − |
| E2 | 4 | − | − | − | − | − |
| E6 | 3 | − | − | − | − | − |
| E6 | 2 | − | + | − | − | + |
| E6 | 1 | − | ++ | − | − | + |
| E6 | 4 | − | − | − | − | − |
| E7 | 3 | − | − | NA | − | NA |
| E7 | 2 | − | − | NA | − | NA |
| E7 | 1 | − | − | NA | − | NA |
| E7 | 4 | − | − | NA | − | NA |

TABLE 24

| | CD4+ Response | | | | | |
|---|---|---|---|---|---|---|
| antigen | Group | HPV16 | HPV18 | HPV33 | HPV35 | HPV45 |
| E1 | 3 | ++ | +++ | ++ | − | ++ |
| E1 | 2 | ++ | +++ | ++ | − | ++ |
| E1 | 1 | − | + | + | − | − |
| E1 | 4 | − | − | − | − | − |
| E2 | 3 | + | − | − | − | − |
| E2 | 2 | + | − | − | − | − |
| E2 | 1 | − | − | − | − | − |
| E2 | 4 | − | − | − | − | − |
| E6 | 3 | − | − | − | − | − |
| E6 | 2 | − | + | − | − | − |
| E6 | 1 | − | − | − | − | − |
| E6 | 4 | − | − | − | − | − |
| E7 | 3 | − | − | NA | − | NA |
| E7 | 2 | − | − | NA | − | NA |
| E7 | 1 | − | − | NA | − | NA |
| E7 | 4 | − | − | NA | − | NA |

As illustrated in FIGS. 18 through 21, more reproducible T cell responses were observed in CB6F1 mice with a combination of two independent ChAd155-HPV constructs (Groups 2 and 3) versus a single construct expressing all proteins in the same construct (Group 1). Between Group 2 (gly linker construct) and Group 3 (2A linker construct), the magnitude of the T cell response was similar.

Figure 18A:
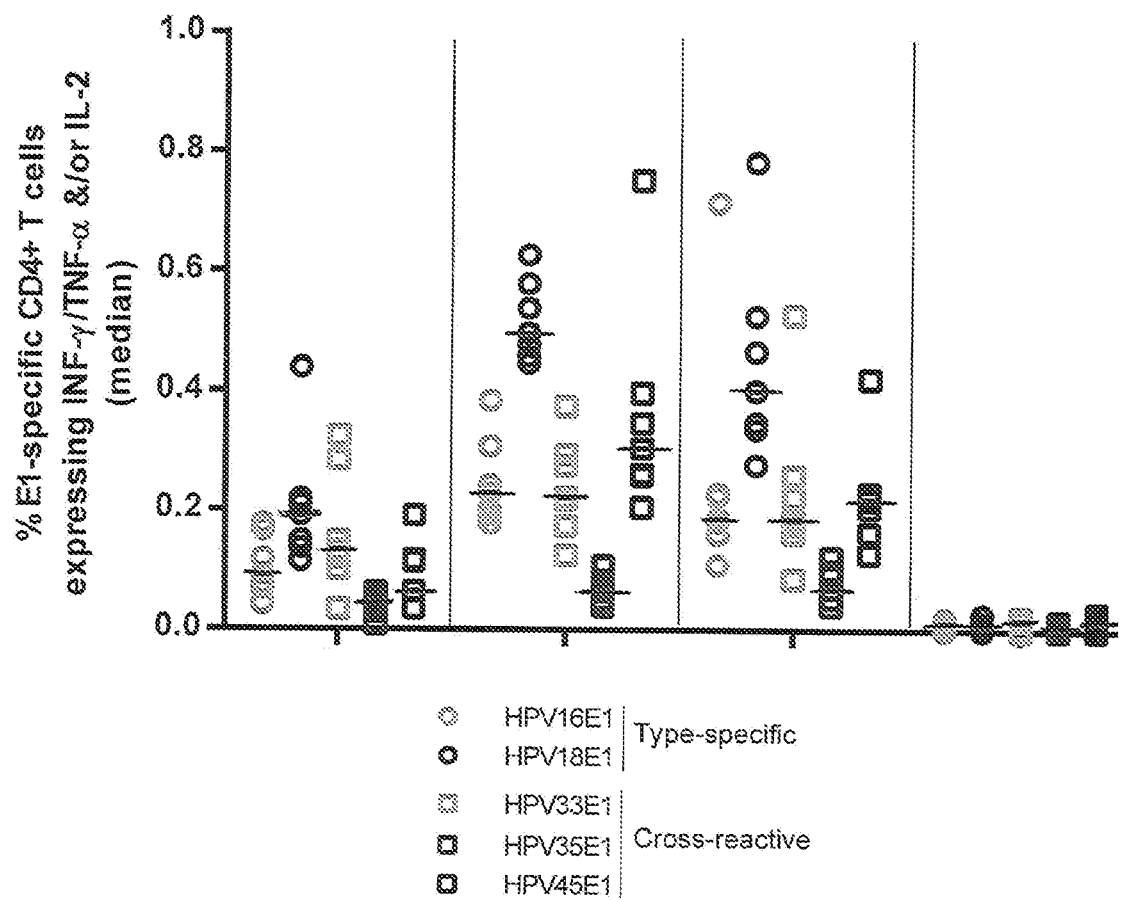
FIG. 18 Graphs the percentage of HPV-E1-specific and cross reactive T cell responses detected in spleen cells of CB6/F1 mice collected after immunization with ChAd155 vector constructs Gly_E2$^3$E6$^5$E1$^2$E7$^2$ (first column), combined administration of Gly_E1$^2$E7$^2$ and Gly-E2$^3$E6$^5$ (second column), combined administration of 2A_E1$^2$E7$^2$ and 2A_E2$^3$E6$^5$ (third column), and NaCl 150 mM (fourth column): (A) results for E1-specific and cross reactive CD4+ T cell responses; (B) results for E1-specific and cross reactive CD8+ T cell responses. The data are shown for individual mice with the median per group indicated by a horizontal line; legend applies to both (A) and (B).
Figure 18B:
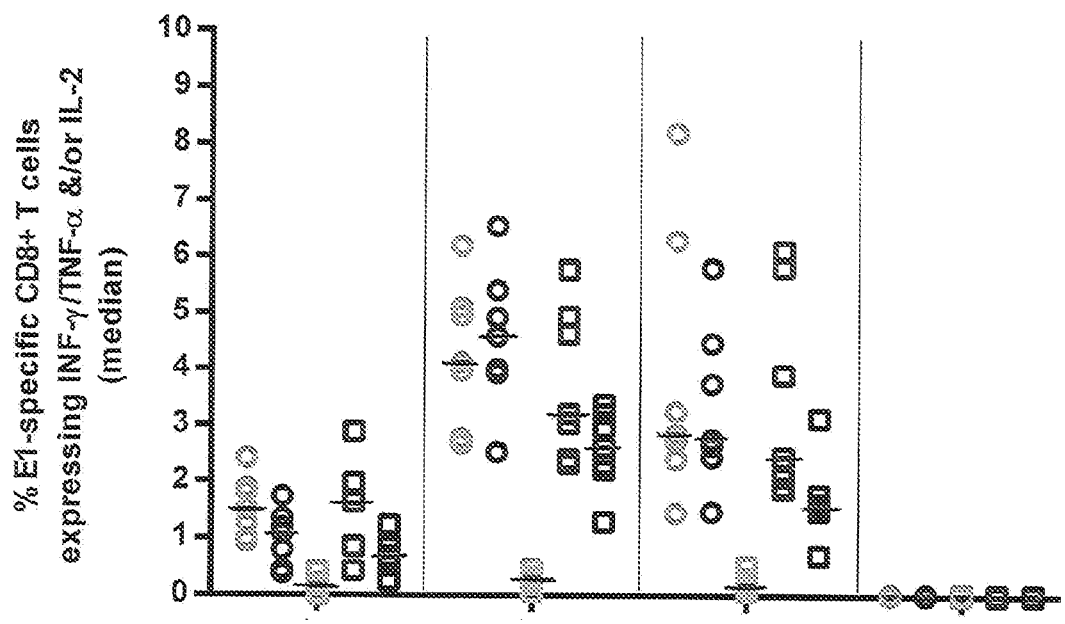
Figure 19A:
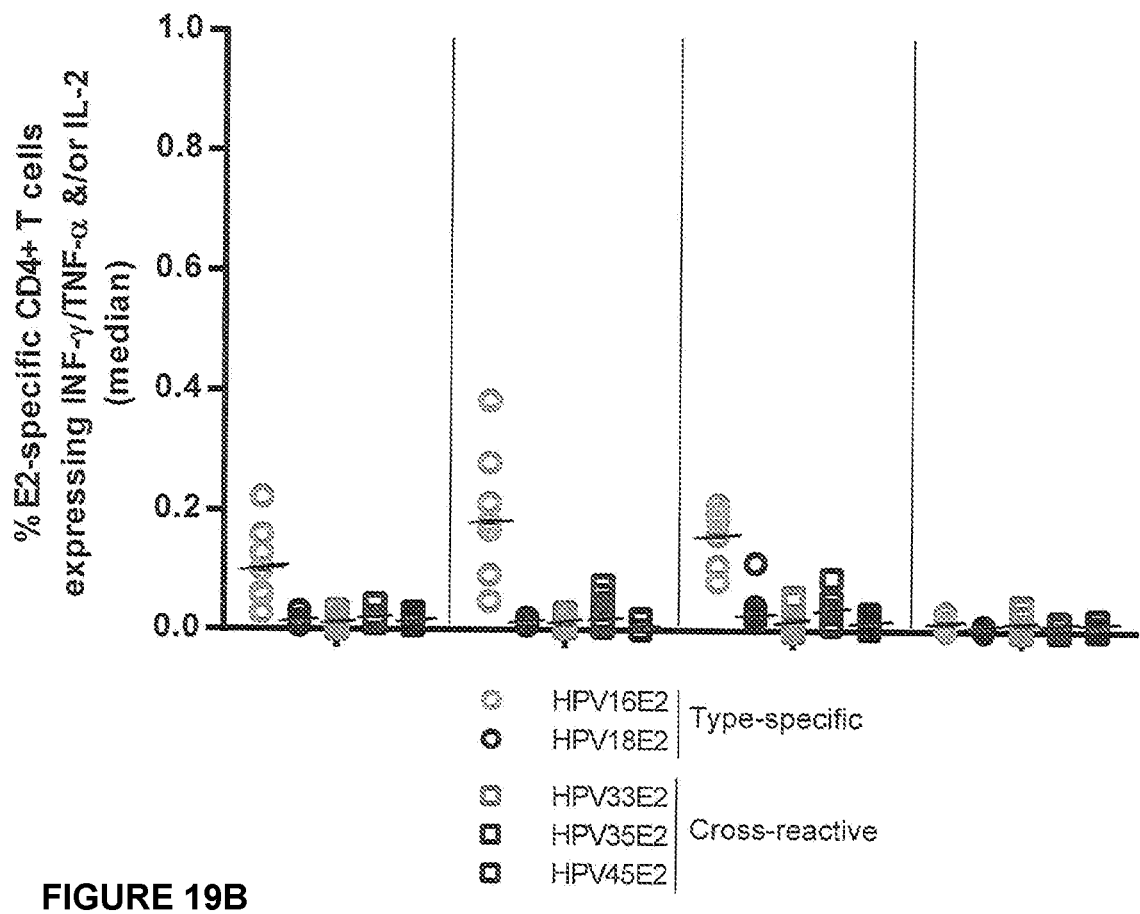
FIG. 19 Graphs the percentage of HPV-E2-specific and cross reactive T cell responses detected in spleen cells of CB6/F1 mice collected after immunization with ChAd155 vector constructs Gly_E2$^3$E6$^5$E1$^2$E7$^2$ (first column), Gly_E1$^2$E7$^2$ and Gly-E2$^3$E6$^5$ (second column), 2A_E1$^2$E7$^2$ and 2A_E2$^3$E6$^5$ (third column), and NaCl 150 mM (fourth column): (A) results for E2-specific and cross reactive CD4+ T cell responses; (B) results for E2-specific and cross reactive CD8+ T cell responses. The data are shown for individual mice with the median per group indicated by a horizontal line; legend applies to both (A) and (B).
Figure 19B:
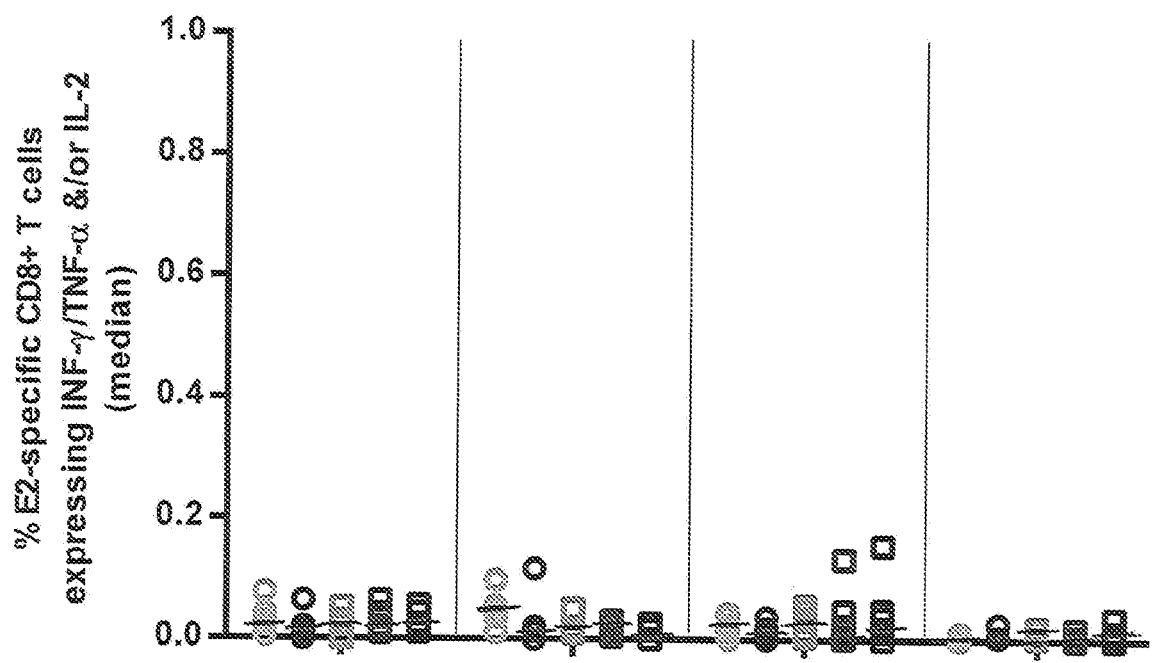
Figure 20A:
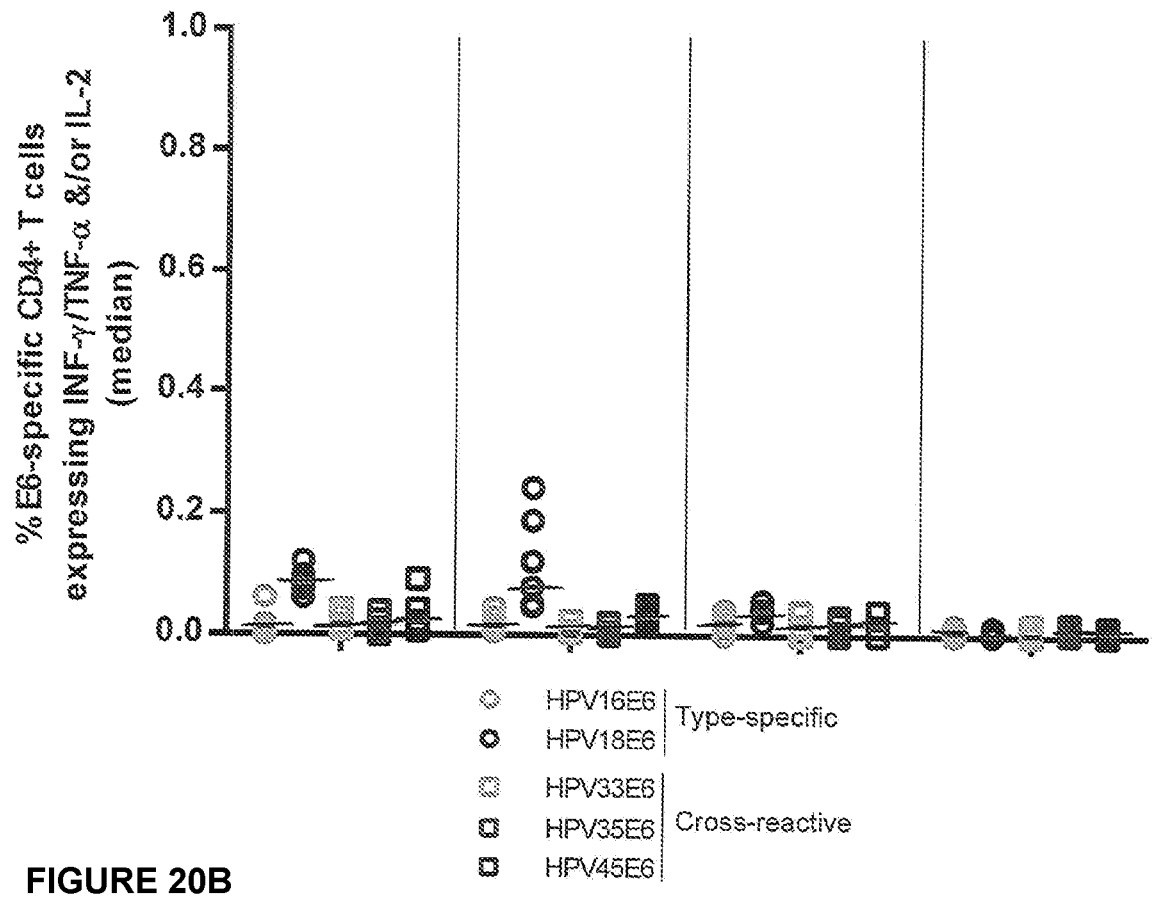
FIG. 20 Graphs the percentage of HPV-E6-specific and cross reactive T cell responses detected in spleen cells of CB6/F1 mice collected after immunization with ChAd155 vector constructs Gly_E2$^3$E6$^5$E1$^2$E7$^2$ (first column), Gly_E1$^2$E7$^2$ and Gly-E2$^3$E6$^5$ (second column), 2A_E1$^2$E7$^2$ and 2A_E2$^3$E6$^5$ (third column), and NaCl 150 mM (fourth column): (A) results for E6-specific and cross reactive CD4+ T cell responses; (B) results for E6-specific and cross reactive CD8+ T cell responses. The data are shown for individual mice with the median per group indicated by a horizontal line; legend applies to both (A) and (B).
Figure 20B:
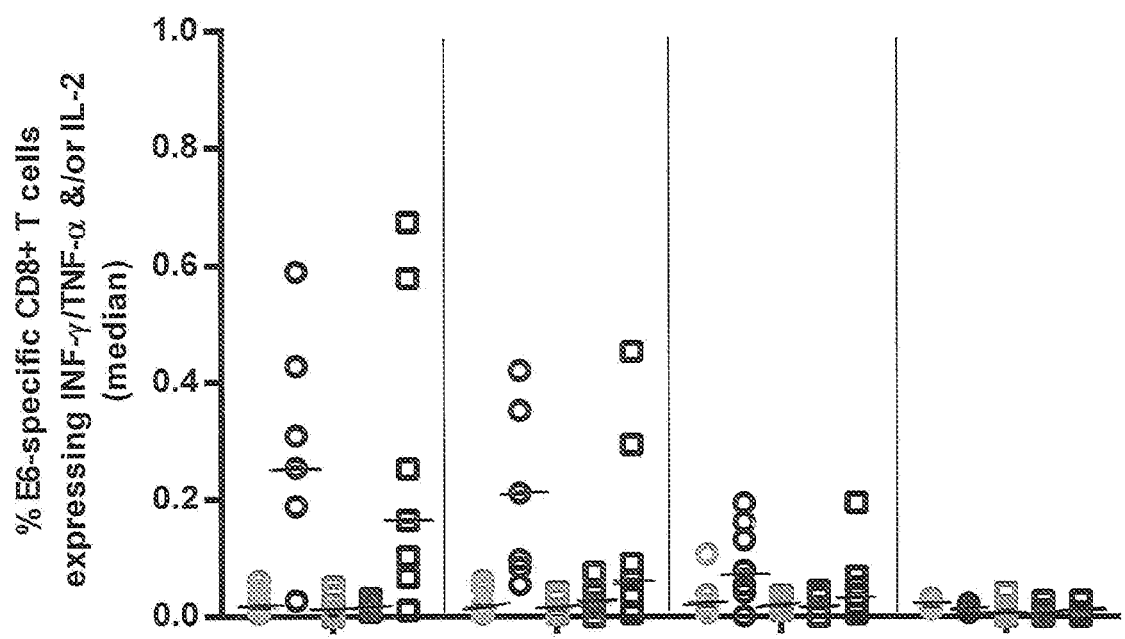
Figures 21A, 21B:
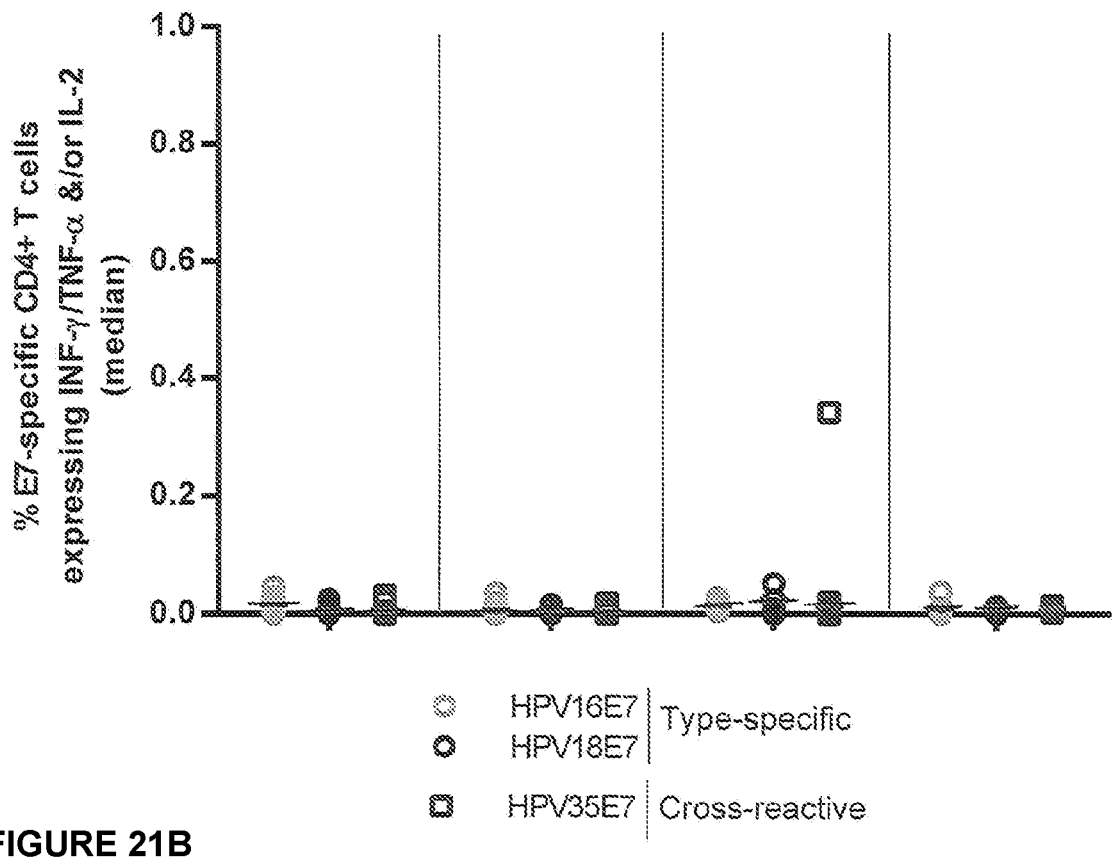
FIG. 21 Graphs the percentage of HPV-E7-specific and cross reactive T cell responses detected in spleen cells of CB6/F1 mice collected after immunization with ChAd155 vector constructs Gly_E2$^3$E6$^5$E1$^2$E7$^2$ (first column), Gly_E1$^2$E7$^2$ and Gly-E2$^3$E6$^5$ (second column), 2A_E1$^2$E7$^2$ and 2A_E2$^3$E6$^5$ (third column), and NaCl 150 mM (fourth column): (A) results for E7-specific and cross reactive CD4+ T cell responses; (B) results for E7-specific and cross reactive CD8+ T cell responses. The data are shown for individual mice with the median per group indicated by a horizontal line; legend applies to both (A) and (B).

HPV-E1 specific CD4+ and CD8+ T cell responses are graphed in FIG. 18A-B, respectively; HPV-E2 specific CD4+ and CD8+ T cell responses are graphed in FIG. 19A-B, respectively; HPV-E6 specific CD4+ and CD8+ T cell responses are graphed in FIG. 20A-B, respectively; and HPV-E7 specific CD4+ and CD8+ T cell responses are graphed in FIG. 21A-B, respectively. Data are shown for individual mice with the median per group shown as a horizontal line.

T Cell Responses to E1 Antigens:

Groups 2 and 3 of CB6F1 mice (immunized with a combination of two independent ChAd155-HPV constructs coding for $E2^3E6^5$ and $E1^2E7^2$ sequences) developed:

- Strong CD8+ T cell responses to HPV16 and HPV18 E1 sequences (median of the response at around 4% and 5% respectively);
- Strong cross-reactive CD8+ T cell responses to HPV35 and HPV45 E1 sequences (median of the response at around 3%) but low response to HPV33 E1 sequence (median of the response at around 0.3%);
- Low but consistent CD4+ T cell responses to HPV16 and HPV18 E1 sequences (median of the response at around 0.3% and 0.5% respectively);
- Limited cross-reactivity to HPV33 and HPV45 E1 sequences (median of the response at around 0.2% and 0.3% respectively); and
- No significant cross-CD4+ T cell response to HPV35 E1 sequence.

T Cell Responses to E2 Antigens:

Groups 2 and 3 of CB6F1 mice (immunized with a combination of two independent ChAd155-HPV constructs coding for $E2^3E6^5$ and $E1^2E7^2$ sequences) developed:

No CD8+ T cell responses to any of E2 sequences tested
Low but consistent CD4+ T cell responses to HPV16E1 sequence (median of the response at around 0.2%). No specific CD4+ T cell responses to HPV18E1 sequence.

T Cell Responses to E6 Antigens:

Low HPV18 and HPV45 E6 CD8+ T cell responses (0.2-0.4%) were detected in some CB6F1 mice that received a combination of ChAd155-HPV constructs coding for $E2^3E6^5$ and $E1^2E7^2$ separated by glycine spacer (Group 2), but were not detected in the other groups.

T Cell Immune Responses to E7 Antigens:

E7 antigens were not seen to be immunogenic in the CB6F1 mice strain.

Example 15: CD8/CD4 T Cell Responses in HLA A2/DR1 tg Mice

Using the materials and methods of Example 13, in vitro stimulation was carried out in the HLA A2/DR1 tg mice. Polypeptides used for stimulation were: HPV16 E1/E2/E6 and E7 pools; HPV18 E1/E2 and E6 pools; HPV35 E1/E2 and E6 pools, all as described in TABLE 21. Additionally, the HPV35 pools of peptides and the HPV16 and HPV18 fusion proteins as described in TABLE 22 were utilized. Specific response was assessed using HPV16 and HPV18 sequences; cross-reactivity was assessed using HPV35 sequences.

The frequencies of HPV-specific CD8+ T cells (or CD4+ T cells) expressing IL-2 and/or TNFα and/or IFNγ were measured by ICS after in vitro stimulation with HPV peptides.

All responses considered are cell proportions (in %) derived from cell counts. For each response an analysis of variance (ANOVA) model was fitted on the log transformed data by considering group and experiment as fixed effects. Homogeneous variance between groups was not assumed.

Geometric mean estimate by vaccination group for the different in vitro stimulations were derived from these models. The comparisons of vaccinated (Groups 1-3) vs. control (Group 4) animals were reported with a geometric mean ratio (with a 95% confidence interval). Graphs of individual data for both cell types and all stimulations were produced (not shown).

Only samples stimulated by E1 antigens seemed to respond compared to control group. Only E1 epitopes were demonstrated to induce a response in mice immunized with Gly_$E2^3E6^5$ and Gly_$E1^2E7^2$ constructs (Group 2) or 2A_$E2^3E6^5$ and 2A_$E1^2E7^2$ constructs (Group 3) among the stimulation conditions used with HLA A2/DR1 tg cells. There was no difference between Group 2 and Group 3 (data not shown). The strongest effect was observed after stimulation with E1 peptides from HPV18 serotype. In both Group 2 and 3, a cross-reactive response was induced (HPV35 E1 stimulations). The magnitude of difference was systematically higher in CD8, compared to CD4, cells.

Geometric means and geometric ratio for E1 stimulation only are shown in TABLES 25 and 26, respectively, where Gly_E2/E6/E1/E7 is Gly_$E2^3E6^5E1^2E7^2$, Gly_E2/E6 is Gly_$E2^3E6^5$, Gly_E1/E7 is Gly_$E1^2E7^2$, 2A_E2/E6 is 2A_$E2^3E6^5$, and 2A_E1/E7 is 2A_$E1^2E7^2$.

TABLE 25

| | | | geometric mean (with 95% confidence interval) | | |
|---|---|---|---|---|---|
| Stimulation | Cell type | Vaccination group | Geometric mean | 95% lower | 95% upper |
| HPV16 E1 | CD4 | gly_E2/E6/E1/E7 | 0.018 | 0.012 | 0.029 |
| | | gly_E2/E6 + gly_E1E7 | 0.077 | 0.055 | 0.108 |
| | | 2A_E2/E6 + 2A_E1/E7 | 0.068 | 0.047 | 0.099 |
| | | NaCl | 0.017 | 0.010 | 0.026 |
| | CD8 | gly_E2/E6/E1/E7 | 0.017 | 0.001 | 0.205 |
| | | gly_E2/E6 + gly_E1/E7 | 0.685 | 0.125 | 3.746 |
| | | 2A_E2/E6 + 2A_E1/E7 | 0.843 | 0.285 | 2.494 |
| | | NaCl | 0.044 | 0.025 | 0.078 |
| HPV18 E1 | CD4 | gly_E2/E6/E1/E7 | 0.026 | 0.019 | 0.036 |
| | | gly_E2/E6 + gly_E1/E7 | 0.192 | 0.130 | 0.285 |
| | | 2A_E2/E6 + 2A_E1/E7 | 0.165 | 0.107 | 0.252 |
| | | NaCl | 0.019 | 0.014 | 0.027 |

TABLE 25-continued geometric mean (with 95% confidence interval)

| Stimulation | Cell type | Vaccination group | Geometric mean | 95% lower | 95% upper |
|---|---|---|---|---|---|
| | CD8 | gly_E2/E6/E1/E7 | 0.222 | 0.027 | 1.823 |
| | | gly_E2/E6 + gly_E1/E7 | 21.515 | 10.708 | 43.230 |
| | | 2A_E2/E6 + 2A_E1/E7 | 18.166 | 9.856 | 33.484 |
| | | NaCl | 0.084 | 0.016 | 0.432 |
| HPV35 E1 CD8 | CD4 | gly_E2/E6/E1/E7 | 0.017 | 0.010 | 0.029 |
| | | gly_E2/E6 + gly_E1/E7 | 0.036 | 0.022 | 0.058 |
| | | 2A_E2/E6 + 2A_E1/E7 | 0.057 | 0.039 | 0.085 |
| | | NaCl | 0.020 | 0.010 | 0.040 |
| | CD8 | gly_E2/E6/E1/E7 | 0.159 | 0.048 | 0.524 |
| | | gly_E2/E6 + gly_E1/E7 | 0.831 | 0.145 | 4.775 |
| | | 2A_E2/E6 + 2A_E1/E7 | 3.223 | 0.869 | 11.960 |
| | | NaCl | 0.049 | 0.036 | 0.067 |
| HPV35 E1 full | CD4 | gly_E2/E6/E1/E7 | 0.011 | 0.006 | 0.021 |
| | | gly_E2/E6 + gly_E1/E7 | 0.010 | 0.006 | 0.017 |
| | | 2A_E2/E6 + 2A_E1/E7 | 0.008 | 0.002 | 0.039 |
| | | NaCl | 0.013 | 0.007 | 0.027 |
| | | gly_E2/E6/E1/E7 | 0.051 | 0.008 | 0.325 |
| | CD8 | gly_E2/E6 + gly_E1/E7 | 0.751 | 0.126 | 4.484 |
| | | 2A_E2/E6 + 2A_E1/E7 | 0.584 | 0.114 | 2.997 |
| | | NaCl | 0.036 | 0.012 | 0.113 |

TABLE 26 geometric mean ratio (GMR, with 95% confidence interval). Only comparisons to control NaCl group are provided. Significant GMRs are underlined.

| Stimulation | Cell type | Comparison (vs. NaCl) | GMR | 95% lower | 95% upper |
|---|---|---|---|---|---|
| HPV16 E1 | CD4 | 1) gly_E2/E6/E1/E7 | 1.105 | 0.643 | 1.900 |
| | | 2) gly_E2/E6 + gly_E1/E7 | <u>4.671</u> | 2.909 | 7.499 |
| | | 3) 2A_E2/E6 + 2A_E1/E7 | <u>4.112</u> | 2.490 | 6.788 |
| | CD8 | 1) gly_E2/E6/E1/E7 | 0.392 | 0.033 | 4.674 |
| | | 2) gly_E2/E6 + gly_E1/E7 | <u>15.463</u> | 2.804 | 85.286 |
| | | 3) 2A_E2/E6 + 2A_E1/E7 | <u>19.023</u> | 6.295 | 57.482 |
| HPV18 E1 | CD4 | 1) gly_E2/E6/E1/E7 | 1.365 | 0.904 | 2.063 |
| | | 2) gly_E2/E6 + gly_E1/E7 | <u>9.969</u> | 6.392 | 15.548 |
| | | 3) 2A_E2/E6 + 2A_E1/E7 | <u>8.535</u> | 5.280 | 13.796 |
| | CD8 | 1) gly_E2/E6/E1/E7 | 2.652 | 0.241 | 29.220 |
| | | 2) gly_E2/E6 + gly_E1/E7 | <u>257.107</u> | 51.227 | 1290.422 |
| | | 3) 2A_E2/E6 + 2A_E1/E7 | <u>217.088</u> | 43.729 | 1077.709 |
| HPV35 E1 CD8 | CD4 | 1) gly_E2/E6/E1/E7 | 0.864 | 0.452 | 1.650 |
| | | 2) gly_E2/E6 + gly_E1/E7 | 1.769 | 0.938 | 3.337 |
| | | 3) 2A_E2/E6 + 2A_E1/E7 | <u>2.860</u> | 1.621 | 5.046 |
| | CD8 | 1) gly_E2/E6/E1/E7 | 3.222 | 0.971 | 10.688 |
| | | 2) gly_E2/E6 + gly_E1/E7 | <u>16.852</u> | 2.930 | 96.932 |
| | | 3) 2A_E2/E6 + 2A_E1/E7 | <u>65.344</u> | 17.551 | 243.273 |
| HPV35 E1 full | CD4 | 1) gly_E2/E6/E1/E7 | 0.805 | 0.348 | 1.865 |
| | | 2) gly_E2/E6 + gly_E1/E7 | 0.781 | 0.377 | 1.619 |
| | | 3) 2A_E2/E6 + 2A_E1/E7 | 0.625 | 0.127 | 3.067 |
| | CD8 | 1) gly_E2/E6/E1/E7 | 1.393 | 0.192 | 10.092 |
| | | 2) gly_E2/E6 + gly_E1/E7 | <u>20.649</u> | 3.169 | 134.548 |
| | | 3) 2A_E2/E6 + 2A_E1/E7 | <u>16.057</u> | 2.822 | 91.361 |

Figure 23A:
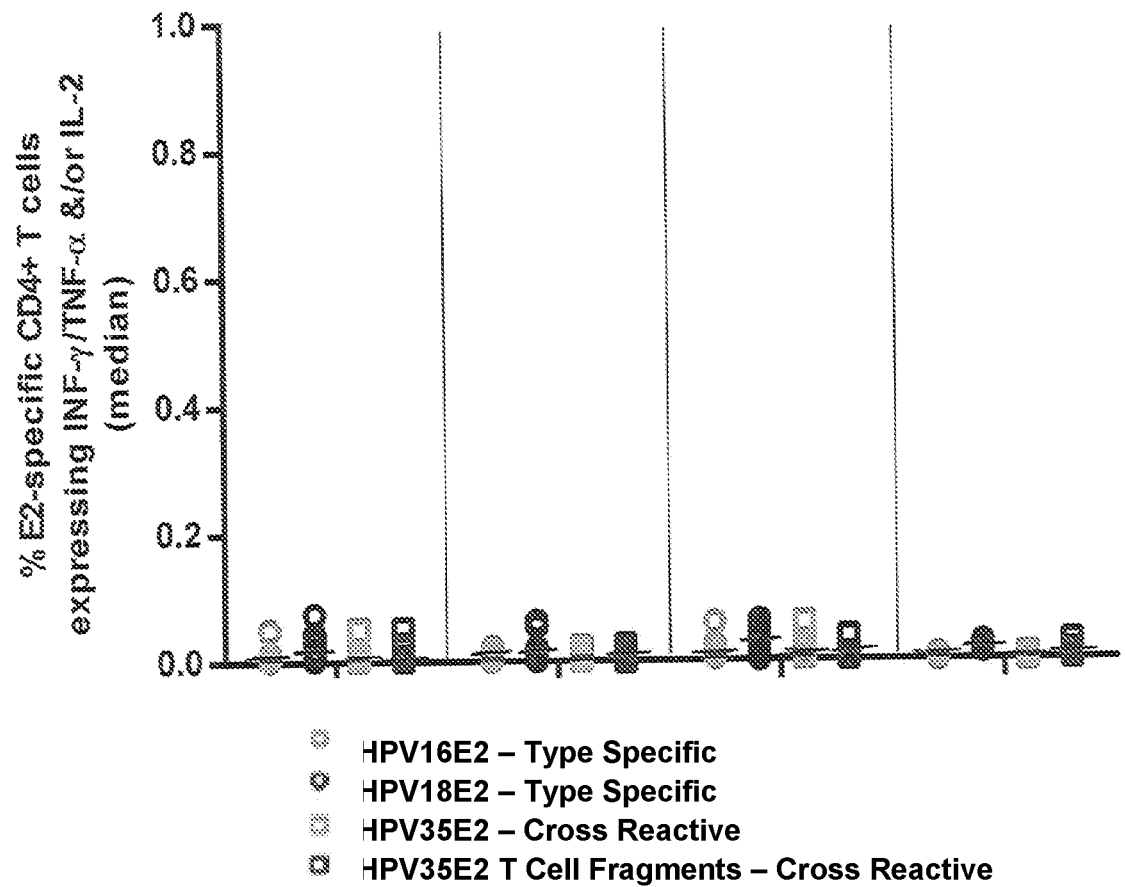
FIG. 23 Graphs the percentage of HPV-E2-specific and cross reactive T cell responses detected in spleen cells of HLA A2/DR1 tg mice collected after immunization with ChAd155 vector constructs Gly_E2$^3$E6$^5$E1$^2$E7$^2$ (first column), Gly_E1$^2$E7$^2$ and Gly-E2$^3$E6$^5$ (second column), 2A_E1$^2$E7$^2$ and 2A_E2$^3$E6$^5$ (third column), and NaCl 150 mM (fourth column): (A) results for E2-specific and cross reactive CD4+ T cell responses; (B) results for E2-specific and cross reactive CD8+ T cell responses. The data are shown for individual mice with the median per group indicated by a horizontal line; legend applies to both (A) and (B).
Figure 23B:
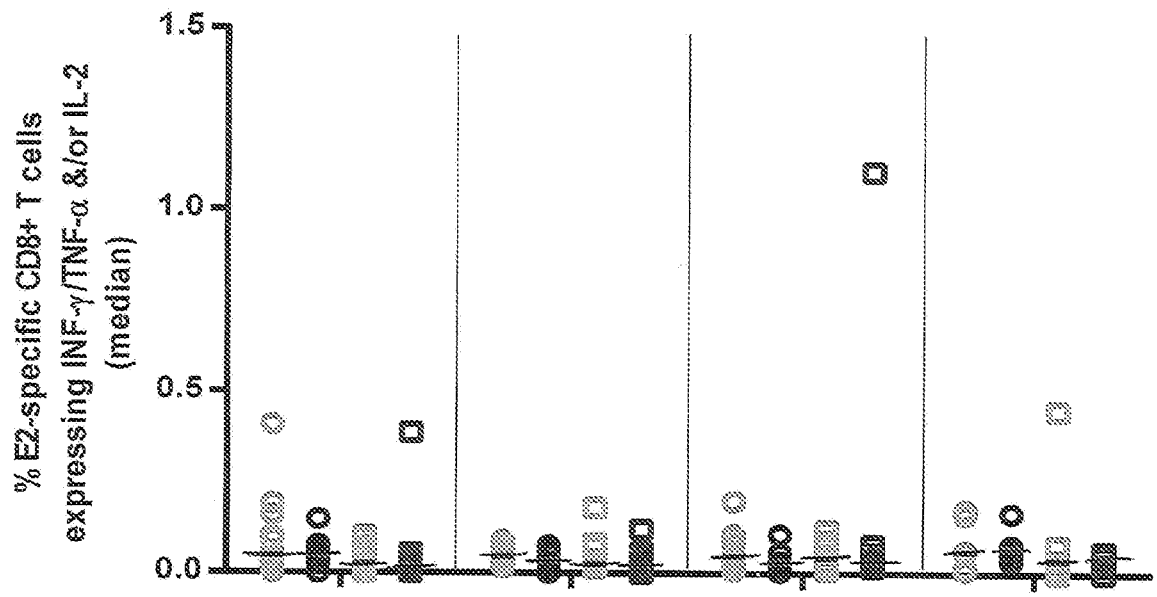
Figures 24A, 24B:
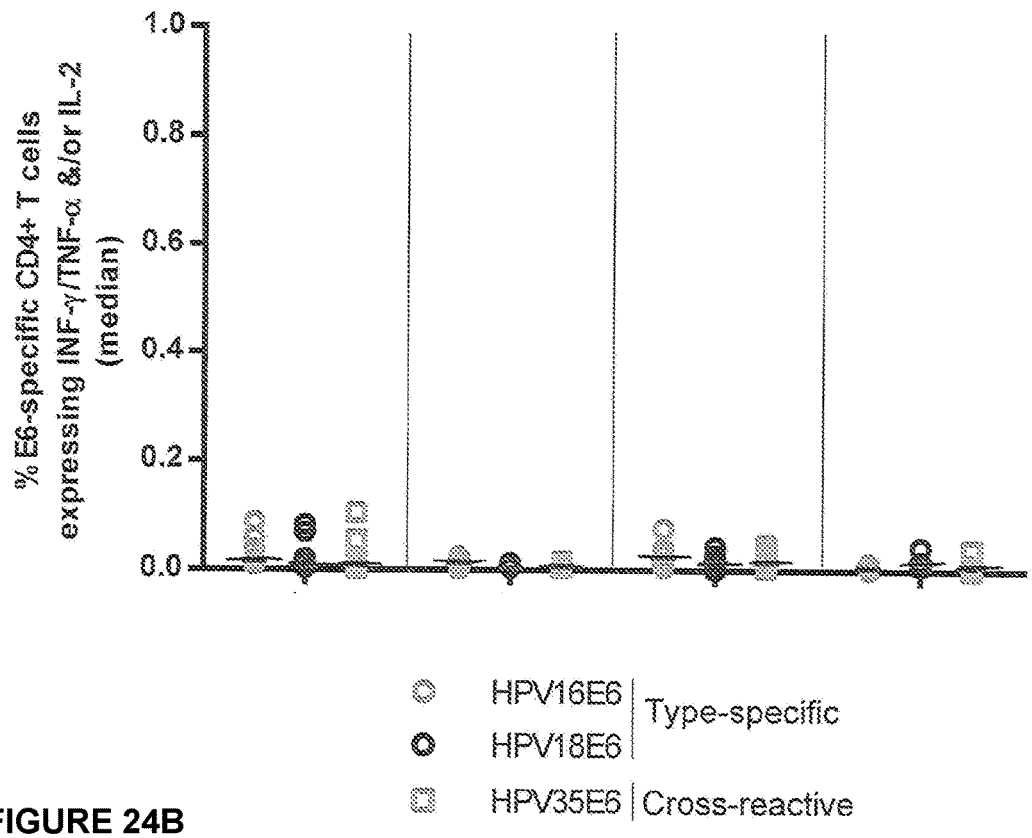
FIG. 24 Graphs the percentage of HPV-E6-specific and cross reactive T cell responses detected in spleen cells of HLA A2/DR1 tg mice collected after immunization with ChAd155 vector constructs Gly_E2$^3$E6$^5$E1$^2$E7$^2$ (first column), Gly_E1$^2$E7$^2$ and Gly-E2$^3$E6$^5$ (second column), 2A_E1$^2$E7$^2$ and 2A_E2$^3$E6$^5$ (third column), and NaCl 150 mM (fourth column): (A) results for E6-specific CD4+ T cell reponses; (B) results for E6-specific CD8+ T cell responses.

As illustrated in FIG. 22 through FIG. 24, more reproducible T cell responses were observed with a combination of two independent ChAd155-HPV constructs (Groups 2 and 3) versus a single construct expressing all proteins in the same construct (Group 1). Between Group 2 (gly linker construct) and Group 3 (2A linker construct), the magnitude of the T cell responses were similar.

Figure 22A:
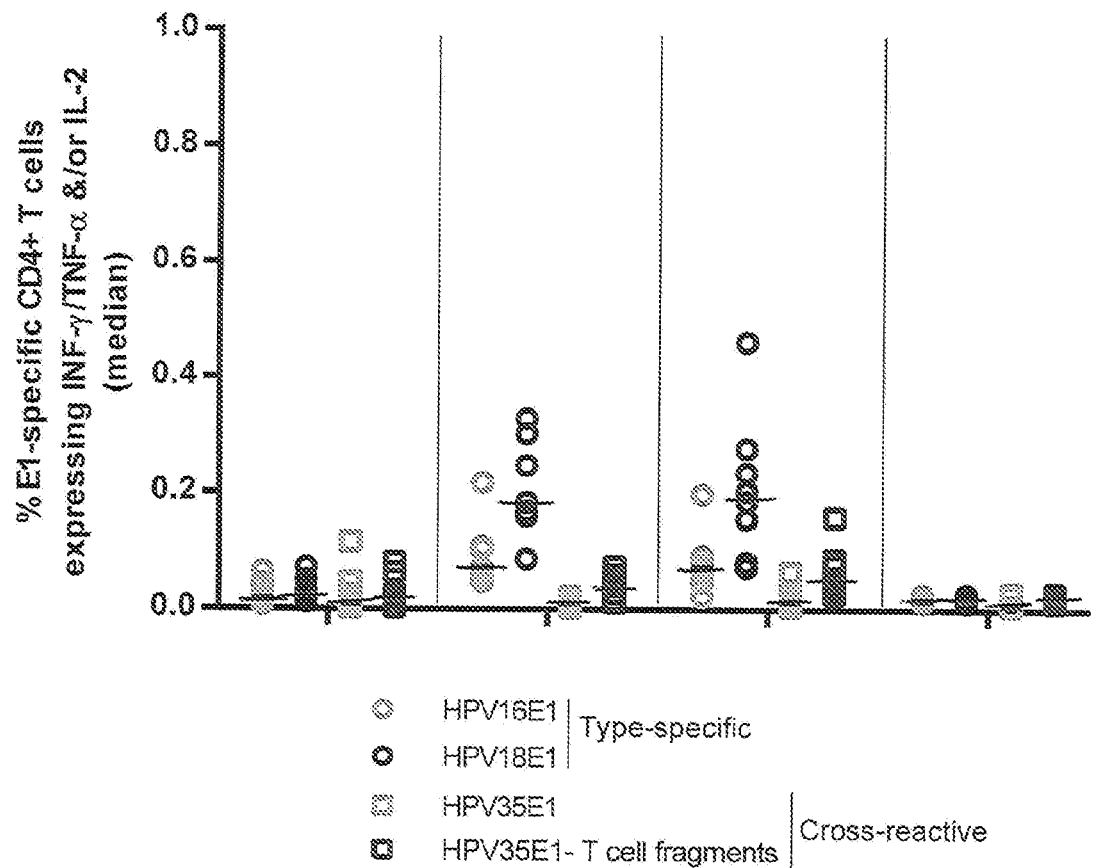
FIG. 22 Graphs the percentage of HPV-E1-specific and cross reactive T cell responses detected in spleen cells of HLA A2/DR1 tg mice collected after immunization with ChAd155 vector constructs Gly_E2$^3$E6$^5$E1$^2$E7$^2$ (first column), Gly_E1$^2$E7$^2$ and Gly-E2$^3$E6$^5$ (second column), 2A_E1$^2$E7$^2$ and 2A_E2$^3$E6$^5$ (third column), and NaCl 150 mM (fourth column): (A) results for E1-specific and cross reactive CD4+ T cell responses; (B) results for E1-specific and cross reactive CD8+ T cell responses. The data are shown for individual mice with the median per group indicated by a horizontal line; legend applies to both (A) and (B).
Figure 22B:
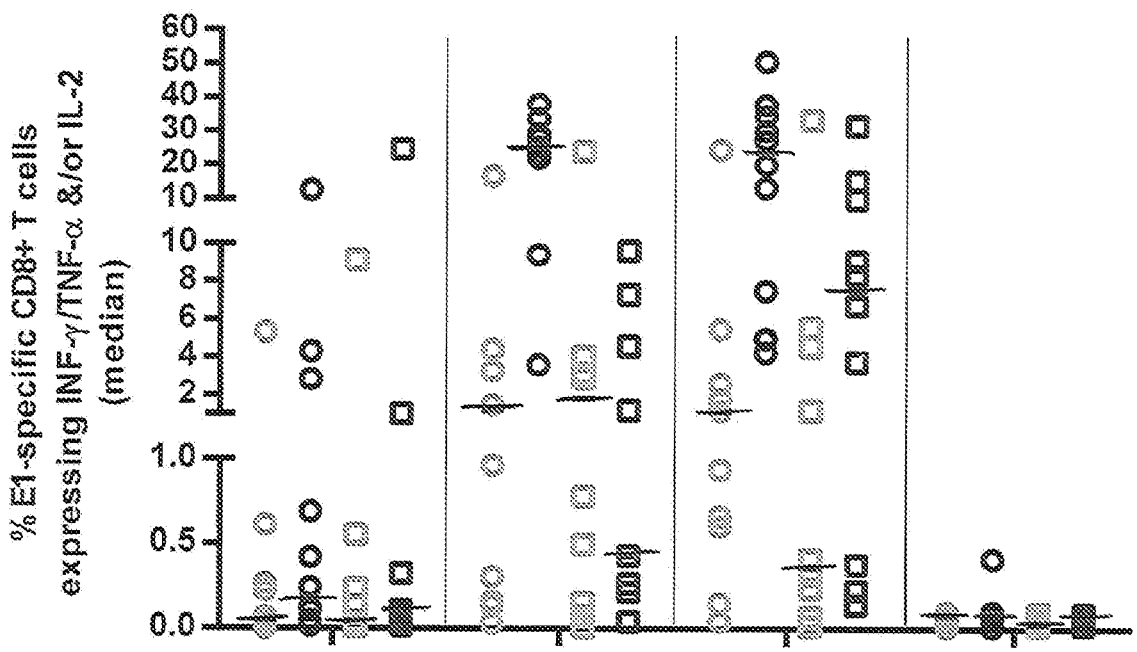

HPV-E1 specific CD4+ and CD8+ T cell responses are graphed in FIG. 22A-B, respectively; HPV-E2 specific CD4+ and CD8+ T cell responses are graphed in FIG. 23A-B, respectively; and HPV-E6 specific CD4+ and CD8+ T cell responses are graphed in FIG. 24A-B, respectively. The data are shown for individual mice with the median per group shown as a horizontal line.

T Cell Responses to E1 Antigens:

Groups 2 and 3 of HLA A2/DR1 tg mice (immunized with a combination of two independent ChAd155-HPV constructs coding for E2$^3$E6$^5$ and E1$^2$E7$^2$ sequences) developed:
  Strong CD8+ T cell responses to HPV16 and HPV18 E1 sequences (median of the response at around 2 and 25% respectively);
  Cross-reactive CD8+ T-cell response to HPV35 E1 sequence (median of the response at around 2% for glycine constructs and 0.5% for 2A constructs). Interestingly, all mice responding to HPV16 E1 sequence also developed cross-reactive CD8+ T-cell response to HPV35 E1 sequence. In contrast, no correlation was observed between HPV18 or HPV35 E1 responders;

Low but consistent CD4+ T cell responses to HPV16 and HPV18 E1 sequences (median of the response at around 0.1 and 0.2% respectively). No cross-reactive CD4+ T cell response was seen to HPV35 E1 sequence.

E1 immunogenicity was negatively impacted when all HPV antigens (E2$^3$E6$^5$ E1$^2$E7$^2$) were inserted in the same ChAd155 vector (Group1).

T Cell Responses to E2 and E6 Antigens:

E2 and E6 sequences were not immunogenic or were poorly immunogenic in the HLA A2/DR1 tg mouse strain.

T Cell Responses to E7 Antigens:

Due to conflicting results obtained following in-vitro stimulation with HPV16 and HPV18 PD1/3-E7 fusion proteins and a pool of E7 peptides, E7-related data were not interpretable.

Example 16: CD8/CD4 T Cell Responses in CD-1 Mice

Using the materials and methods of Example 13, in vitro stimulation was carried out in the CD-1 mice using the peptide pools as described in TABLE 21. Specific responses were assessed using HPV16 and HPV18 peptide pools; cross reactivity was assessed using HPV33, HPV35 and HPV45 peptide pools Estimates of the geometric means and their 95% confidence intervals (CI) were calculated using back-transformation on log 10 values. For log transformations, values equal to 0 are set to 0.0001.

To assess the level of response, the posterior predictive probability to observe a new value above the 0.2% threshold, i.e. the activity threshold, was computed for each group. A non-informative prior was used to compute the joint posterior distributions of the mean and standard deviation. Based on the predictive probability of success, i.e. a new response>0.2%, the response was further categorized as negative (−), mild (+), moderate (++) or substantial (+++) based on the predictive probability falling into the [0, 25%], (25%, 50%], (50%, 75%] or (75%, 100%] intervals respectively.

For each mouse Group (1, 2, 3 or 4), a table was generated displaying the mean and 95% CI (lower CL, upper CL) of each response; the posterior predictive distribution and the level of response was also generated (data not shown). Responses: CD4+ and CD8+ T cell responses to each of E1, E2, and E6 from each of HPV16, HPV18, HPV33, HPV35, and HPV45; CD4+ and CD8+ T cell responses to E7 from each of HPV16, HPV18, and HPV35.

Results from the experiment are summarized in TABLES 27 and 28 below, where the level of response (CD8/CD4) is displayed by group antigen and serotype, and where Gly_E2/E6/E1/E7 is Gly_E2$^3$E6$^5$E1$^2$E7$^2$, Gly_E2/E6 is Gly_E2$^3$E6$^5$, Gly_E1/E7 is Gly_E1$^2$E7$^2$, 2A_E2/E6 is 2A_E2$^3$E6$^5$, and 2A_E1/E7 is 2A_E1$^2$E7$^2$.

The levels of responses are defined as follows:

"+++" Prob(New response>0.2%|data)>75%

"++" Prob(New response>0.2%|data) in (50%, 75%]

"+" Prob(New response>0.2%|data) in (25%, 50%]

"−" Prob(New response>0.2%|data)<=25%

TABLE 27

| | CD8+ Response | | | | | |
|---|---|---|---|---|---|---|
| antigen | Group | HPV16 | HPV18 | HPV33 | HPV35 | HPV45 |
| E1 | 3) 2A_E2/E6 + 2A_E1/E7 | +++ | +++ | ++ | ++ | ++ |
| E1 | 2) gly_E2/E6 + gly_E1/E7 | +++ | +++ | +++ | +++ | +++ |
| E1 | 1) Gly_E2/E6/E1/E7 | ++ | +++ | + | + | + |
| E1 | 4) NaCl | − | − | − | − | − |
| E2 | 3) 2A_E2/E6 + 2A_E1/E7 | + | + | − | − | − |
| E2 | 2) gly_E2/E6 + gly_E1/E7 | + | + | − | − | − |
| E2 | 1) Gly_E2/E6/E1/E7 | − | − | − | − | − |
| E2 | 4) NaCl | − | − | − | − | − |
| E6 | 3) 2A_E2/E6 + 2A_E1/E7 | + | + | − | − | − |
| E6 | 2) gly_E2/E6 + gly_E1/E7 | + | ++ | − | − | − |
| E6 | 1) Gly_E2/E6/E1/E7 | − | − | − | − | − |
| E6 | 4) NaCl | − | − | − | − | − |
| E7 | 3) 2A_E2/E6 + 2A_E1/E7 | − | + | NA | − | NA |
| E7 | 2) gly_E2/E6 + gly_E1/E7 | + | + | NA | − | NA |
| E7 | 1) Gly_E2/E6/E1/E7 | − | ++ | NA | − | NA |
| E7 | 4) NaCl | − | − | NA | − | NA |

TABLE 28

| | CD4+ Response | | | | | |
|---|---|---|---|---|---|---|
| antigen | Group | HPV16 | HPV18 | HPV33 | HPV35 | HPV45 |
| E1 | 3) 2A_E2/E6 + 2A_E1/E7 | − | +++ | − | − | − |
| E1 | 2) gly_E2/E6 + gly_E1/E7 | − | +++ | − | − | − |
| E1 | 1) gly_E2/E6/E1/E7 | − | + | − | − | − |
| E1 | 4) NaCl | − | − | − | − | − |
| E2 | 3) 2A_E2/E6 + 2A_E1/E7 | + | + | − | − | − |
| E2 | 2) gly_E2/E6 + gly_E1/E7 | + | + | − | − | − |
| E2 | 1) gly_E2/E6/E1/E7 | ++ | ++ | − | − | − |
| E2 | 4) NaCl | − | − | − | − | − |

TABLE 28-continued

| | CD4+ Response | | | | | |
|---|---|---|---|---|---|---|
| antigen | Group | HPV16 | HPV18 | HPV33 | HPV35 | HPV45 |
| E6 | 3) 2A_E2/E6 + 2A_E1/E7 | – | – | – | – | – |
| E6 | 2) gly_E2/E6 + gly_E1/E7 | – | – | – | – | – |
| E6 | 1) gly_E2/E6/E1/E7 | – | – | – | – | – |
| E6 | 4) NaCl | – | – | – | – | – |
| E7 | 3) 2A_E2/E6 + 2A_E1/E7 | – | – | NA | – | NA |
| E7 | 2) gly_E2/E6 + gly_E1/E7 | – | – | NA | – | NA |
| E7 | 1) gly_E2/E6/E1/E7 | – | – | NA | – | NA |
| E7 | 4) NaCl | – | – | NA | – | NA |

As illustrated in FIG. 25 through FIG. 28, more reproducible T cell responses were observed with a combination of two independent ChAd155-HPV constructs (Groups 2 and 3) versus a single construct expressing the same antigens in a single construct (Group 1). Between Group 2 (gly linker construct) and Group 3 (2A linker construct), the magnitude of the T cell response was similar.

Figure 25A:
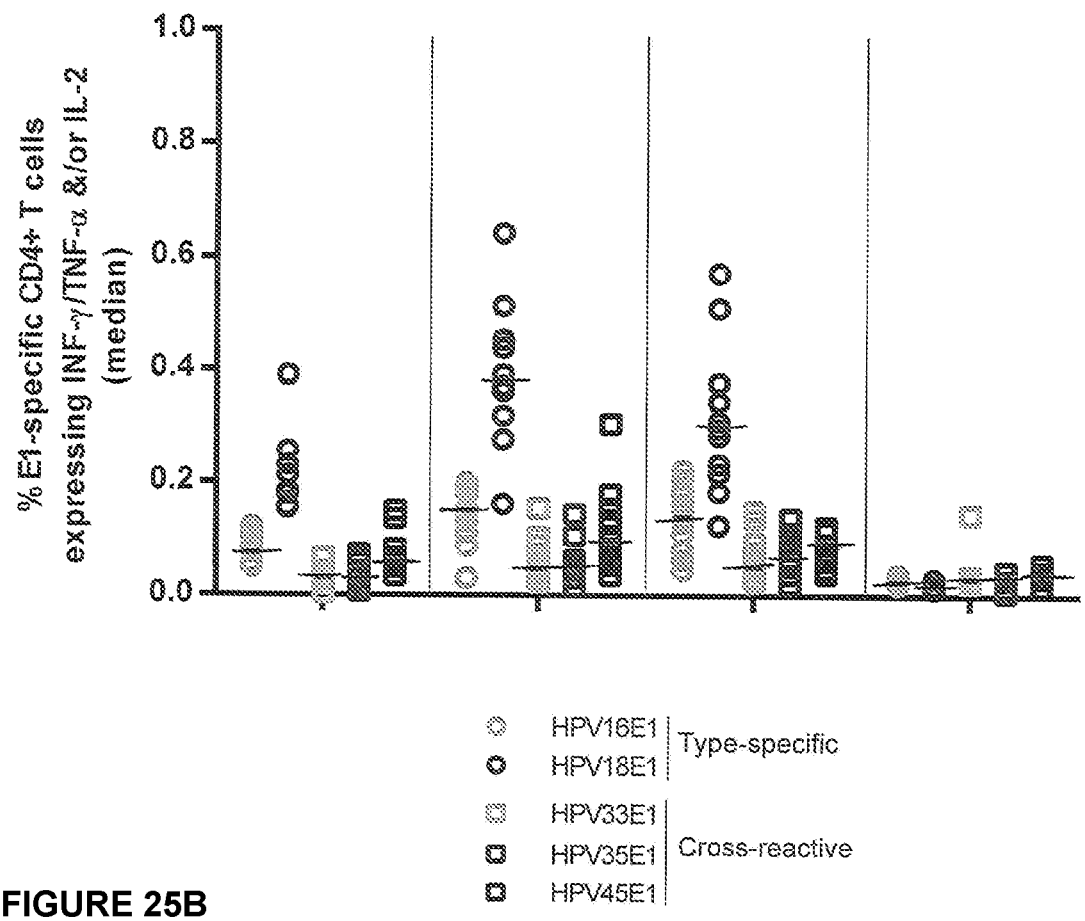
Figure 25B:
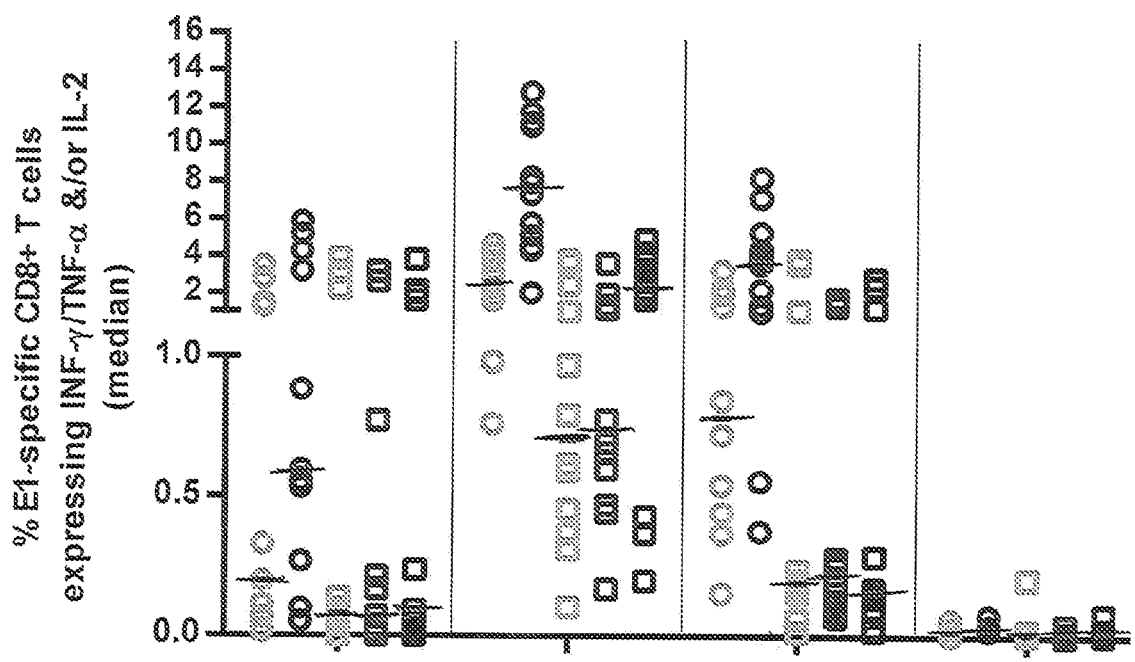

HPV-E1 specific CD4+ and CD8+ T cell responses are graphed in FIG. 25A-B, respectively; HPV-E2 specific CD4+ and CD8+ T cell responses are graphed in FIG. 26A-B, respectively; HPV-E6 specific CD4+ and CD8+ T cell responses are graphed in FIG. 27A-B, respectively; and HPV-E7 specific CD4+ and CD8+ T cell responses are graphed in FIG. 28A-B, respectively. Data are shown for individual mice with the median per group shown as a horizontal line.

T Cell Responses to E1 Antigens
  Strong HPV16 and HPV18 E1 CD8+ T cell responses were observed in all CD-1 test groups (Groups 1-3).
  Some responders to HPV16 and HPV18 E1 sequences also developed strong cross-reactive CD8+ T cell responses to HPV33, HPV35, and HPV45 E1 sequences.
  Low HPV16 E1 CD4+ T cell responses were observed in all groups. No responses to HPV16, HPV33, HPV35 or HPV45 E1 sequences were observed.
T Cell Responses to E2 Antigens
  Significant CD8+ T cell responses to HPV16 and HPV18 E2 sequences were observed in some CD-1 mice immunized with a combination of two independent ChAd155-HPV constructs designed with glycine linkers (Group 2) or with a single ChAd155-HPV construct (Group 1). Interestingly, cross-reactive CD8+ T cells responding to HPV35 E2 sequence but not to HPV33 or HPV45 E2 sequences were also observed in these mice.
  Low CD4+ T cell responses to HPV16, HPV18 and HPV35 E2 sequences were observed in all CD-1 groups.
T Cell Responses to E6 Antigens
  Significant CD8+ T cell responses to HPV16 and HPV18 E6 sequences were observed in some CD-1 mice immunized with a combination of two independent ChAd155-HPV constructs (Groups 2 and 3). No cross-reactivity to HPV33, HPV35, or HPV45 E6 sequences was observed.
  No E6-specific CD4+ T cell responses were detected.
T Cell Responses to E7 Antigens
  Strong CD8+ T cells responding to HPV18 E7 sequences were detected in all CD-1 groups, while HPV16 E7-specific CD8+ T cell response was only detected in some CD-1 mice immunized with a combination of two independent ChAd155-HPV constructs designed with 2A linkers (Group 3). No cross-reactive HPV35 E7 CD8+ T cell response was observed.
  No E7-specific CD4+ T cell responses were detected.
Discussion: HPV-Specific CD4+/CD8+ T Cell Responses The CD4+/CD8+ T cell immune responses induced from ChAd155-HPV constructs coding for recombinant HPV E1, E2, E6 and E7 protein sequences was investigated 21 days post $2^{nd}$ immunization in outbred (CD-1 mice) and inbred mouse models (CB6F1 and HLA A2/DR1 mice). Results indicate that the combined administration of two ChAd155-HPV constructs, one encoding recombinant HPV $E2^3E6^5$ protein sequences and one encoding recombinant HPV $E1^2E7^2$ protein sequences (Groups 2 and 3), induced higher and more reproducible HPV-specific CD8+ T cell responses than use of a single ChAd155 construct coding for Gly_$E2^3E6^5E1^2E7^2$ recombinant protein sequences (Group 1).

The magnitude and the quality of the T cell immune response induced by the combined administration of two ChAd155-HPV constructs was similar whether the sequences encoding the HPV protein sequences contained glycine or 2A linkers.

Example 17: Immunogenicity of Constructs Targeting 7 hrHPV Types in Mouse Models Within these experiments, CB6F1, CD-1 or HLA A2/DR1 transgenic (tg) mice aged 6-8 weeks were randomly assigned to the study groups (n=8/group for CB6F1 and n=12/group for CD-1 & HLA A2/DR1 tg mice) and kept at the institutional animal facility under specified pathogen-free conditions. Mice were vaccinated intramuscularly (i.m.) with a combination of 2 independent ChAd155-HPV constructs in the gastrocnemius muscle ($10^9$ VP/dose in 50 μl) at two different time points (day0 and day 21).

The antigenic sequences, inserted inside two independent ChAd155-HPV constructs injected in combination, were coding for:
  Approach 1: Recombinant sequences of HPV16/18/33 E1, HPV16/18 E7 and HPV45/52/58 E2 (construct 1)+recombinant sequences of HPV16/18/31/33 E2 and HPV16/18/31/33/45/52/58 E6 (construct 2), as described in Example 11 and FIG. 15. These recombinant sequences were either linked by glycine spacers or 2A cleavage sites.
  Approach 2: Recombinant sequences of HPV16/18/33/45 E1 and HPV16/18 E7 (construct 1)+recombinant sequences of HPV16/18/33/52/58 E2 and HPV16/18/31/45/52/58 E6 (construct 2), as described in Example 12 and FIG. 16. These recombinant sequences were either linked by glycine spacers or 2A cleavage sites.

For each strain of mice, an additional negative control group (n=4/group for CB6F1, n=6/group for CD-1 & n=8/ group HLA A2/DR1 tg mice) was immunized i.m. at two different time points (Day 0 and Day 21) with NaCl 150 mM.

Six weeks post-prime immunization, all group of mice were euthanized. Splenocytes were isolated and processed to determine specifically the frequencies of HPV-specific CD4+/CD8+ T cell responses to E1, E2, E6 & E7 antigens of HPV16/18/33/35 or 45 types. However, due to technical constraints (not enough splenocytes to perform all ex-vivo HPV peptide stimulations), spleens from HLA A2/DR1 tg mice were pooled by 2.

Serum samples were also collected at six weeks post post-prime immunization in each groups of mice and stored in case of further investigations Cellular Immune Response—Intracellular Cytokine Staining (ICS)

The frequencies of HPV-specific CD4+& CD8+ T-cells producing IL-2, IFN-γ and/or TNF-α were evaluated by intracellular cytokines staining (ICS) in splenocytes collected days 21 post2nd immunization.

Isolation of Splenocytes—

Spleens were collected from individual mouse for each strain of mice 42 days after primo-immunization. In order to get a sufficient cell number to perform all ex-vivo analysis, spleens collected from HLA A2/DR1 tg mice were randomly pooled (6 pools of 2 spleens).

Spleens were collected and placed in RPMI 1640 medium supplemented with RPMI additives (Glutamine, Penicillin/streptomycin, Sodium Pyruvate, non-essential amino-acids & 2-mercaptoethanol) (=RPMI/additives). Cell suspensions were prepared from each spleen using a tissue grinder. The splenic cell suspensions were filtered (cell stainer 100 μm) and then the filter was rinsed with 40 ml of cold RPMI/additives. After centrifugation (335 g, 10 min at 4° C.), cells were resuspended in 5 ml of RPMI/additives. A second washing step was performed as previously describe and the cells were finally resuspended in 4 ml of RPMI/additives supplemented with 5% FCS.

Cell suspensions were then diluted 20× (10 μl) in PBS buffer (190 μl) for cell counting (using MACSQuant Analyzer). After counting, cells were centrifuged (335 g, 10 min at RT) and resuspended at $10^7$cells/ml in RPMI/additives supplemented with 5% FCS.

Cell Preparation—

Fresh pools of splenocytes were seeded in round bottom 96-well plates at approximately 1 million cells per well. For HLA A2/DR1 tg mice, each sample was plated in triplicate in order to record, by flow cytometry, a sufficient number of CD8 T cells (>5000 events). Splenocytes were then stimulated for 6 hours (37° C., 5% $CO_2$) with anti-CD28 (clone 37.51) and anti-CD49d (clone 9C10 (MFR4.B)) at 1 μg/ml, with or without 100 μl of:

- a pool of 15mer peptides overlapping by 11aa covering the whole amino acids sequence of HPV16/18E1/E2/E6/E7 & HPV35E7 proteins (working concentration: 1 μg/ml per peptide).
- a pool of 15mer peptides overlapping by 11aa covering the antigen-designed protein sequence of HPV33/35/45E1/E2/E6 proteins (working concentration: 1 μg/ml per peptide).
- a pool of 15mer peptides overlapping by 11aa covering the predicted human CD8 T cell epitopes enriched regions of HPV35E1/E2 proteins (working concentration: 1 μg/ml per peptide). This stimulation was only performed in HLA A2/DR1 tg mice).
- PMA—ionomycin solution at working concentrations of 0.25 μg/ml and 2.5 μg/ml respectively (as positive control of the assay).

After 2 hours of ex vivo stimulation, Brefeldin A diluted 1/1000 (1 μg/mL) in RPMI/additives supplemented with 5% FCS was added for 4 additional hours to inhibit cytokine secretion. Plates were then transferred at 4° C. overnight.

Intracellular Cytokine Staining (ICS)—

After overnight incubation at 4° C., cells were transferred to V-bottom 96-well plates, centrifuged (150 g, 5 min at 4° C.) and washed in 250 μl PBS 1% FCS. After a second centrifugation (150 g, 5 min at 4° C.) cells were resuspended, to block unspecific antibody binding, in 50 μl of Flow buffer (PBS 1%, FCS) containing anti-CD16/32 antibodies (clone 2.4G2) diluted 1/50 for 10 min at 4° C. Then, 50 μl Flow Buffer containing mouse anti-CD4-V450 antibody (clone RM4-5, diluted at 1/100) and anti-CD8-PerCp-Cy5.5 antibody (clone 53-6.7, diluted at 1/50) and Live/Dead' Fixable Yellow dead cell stain (1/500) was added for 30 min in obscurity at 4° C. After incubation, 100 μl of Flow buffer were added into each well and cells were then centrifuged (150 g for 5 min at 4° C.). A second washing step was performed with 200 μl of Flow buffer and after centrifugation, cells were fixed and permeabilized by adding 200 μl of Cytofix-Cytoperm solution for 20 min at 4° C. in the dark. After plates centrifugation (150 g for 5 min at 4° C.), cells were washed twice with 200 μl of Perm/Wash buffer and resuspended in 50 μl of Perm/Wash buffer containing mouse anti-IL2-FITC (clone JES6-5H4, diluted 1/400), anti-IFNγ-APC (clone XMG1.2, diluted 1/200) and anti-TNFa-PE (clone MP6-XT22, diluted 1/700) antibodies, for 1 hours at 4° C. Cells were then finally washed twice with 200 μl of Perm/Wash buffer and resuspended in 220 μl PBS.

Cells were then pelleted (150 g, 5 min at 4° C.) and washed with Perm Wash (Kit BD) and resuspended in 50 μl of anti-IFNg APC (1/200)+anti-IL-2 FITC (1/400)+anti-TNFa PE (1/700) diluted in PermWash. After 1 h incubation at 4° C., cells were pelleted and washed with Perm Wash and finally resuspended in 220 μl PBS.

Cell Acquisition and Analysis—

Stained cells were analyzed by flow cytometry using a LSRII flow cytometer and the FlowJo software. Live cells were identified with the Live/Dead staining and then lymphocytes were isolated based on FSC/SSC gating. The acquisition was performed on about 20,000 CD4+ T-cell events and about 5,000 CD8+ T-cell events. The percentages of IFN-γ$^+$/IL-2$^+$ and TNFα$^{+/-}$ producing cells were calculated on CD4+ and CD8+ T cell populations.

T Cell Immune Responses

The frequencies of HPV-specific and cross reactive CD4+/CD8+ T cells reacting to several HPV antigens (E1, E2, E6 & E7) of several high risk HPV types (HPV16, 18, 33, 45, 35) were measured, after ex-vivo HPV peptide pool stimulations, 21 days post 2nd ChAd155-HPV immunization. In approach 1 and 2, specific CD4+/CD8+ T cell immune responses were investigated in different groups of mice by performing ex vivo splenocytes stimulation with pools of peptides covering the whole amino acid sequences of different HPV proteins present in the inserts. Cross-reactive CD4+/CD8+ T cell immune responses were also investigated by stimulating splenocytes with pools of peptides covering the antigen-designed sequences of several HPV proteins (E1, E2 and E6) for different HPV types that were not present in the vectors. In addition, a pool of peptides covering the whole amino acid sequence of the full length HPV35 E7 protein (HPV33/45 E7 peptide pools were not available) was tested to detect cross reactive immune response against E7 of HPV35. Finally, in HLA A2/DR1 tg mice, stimulation of splenocytes with peptide pools covering the predicted human CD8+ T cell epitopes enriched regions of HPV35E1/E2 proteins were also evaluated in term of cross reactive immune response. The CD4+/CD8+ T cell responses were investigated from individual mouse spleen in inbred CB6F1 & outbred CD-1 mouse models. For inbred HLA A2/DR1 tg mouse models, spleens were randomly pooled (6 pools of 2 spleens).

Results in CB6F1 Mouse Model

The Results in CB6F1 mouse model are shown in FIGS. 29 and 30.

Assessment of HPV-Specific and Cross Reactive CD8+ T Cell Responses (FIG. 29):

Compared to NaCl control group, each vaccinated group developed a strong and consistent HPV-E1 specific and cross reactive CD8+ T cell responses towards all high risk HPV types tested ex vivo. No major difference in term of specific and cross-reactive CD8+ T cell responses was detected between the 4 vaccinated groups.

In each vaccinated group, HPV-specific and cross reactive CD8+ T cell responses against HPV16/18/33 E2 proteins inserted into the vectors were almost undetectable. Only few mice from each vaccinated group were able to respond at low level against HPV35 E2. Interestingly, HPV45 specific (approach 1) or cross reactive (approach 2) CD8+ T cell response to E2 were detected in all vaccinated groups of mice. The percentages of responders detected in mice vaccinated with gly or 2A approach 1 (100% or responder) were higher than those measured in mice vaccinated with gly or 2A approach 2 (50% and 25% of responders respectively).

HPV-specific/cross reactive CD8+ T cell responses to HPV16/18/33/35/45 E6 antigens were detected in each vaccinated group compared to NaCl control group. Although the magnitude of HPV18/45 E6-specific CD8+ T cell responses seems to be higher in groups of mice vaccinated with 2A approach 1 compared to other group of mice, the high variability of the responses required further investigations to confirm this finding. No major difference was observed between animals vaccinated with approach 1 or 2 in terms of specific/cross-reactive CD8+ T cell responses.

No detection of HPV16/18 specific and HPV35 cross-reactive CD8+ T cell responses to E7 antigens.

In summary, in CB6F1 mice, CD8+ T cells reactivity was higher to E1 and E6 antigens compared to E2 and E7 antigens.

Assessment of HPV-Specific and Cross Reactive CD4+ T Cell Responses (FIG. 30):

Intermediate levels of HPV-specific/cross reactive CD4+ T cell responses to HPV18/33/45 E1 antigens were detected in each vaccinated group of mice compared to NaCl control group. Low but detectable levels of HPV16-specific CD4+ T cell responses to E1 antigens were also observed in all vaccinated groups. HPV35 cross reactive CD4+ T cell responses to E1 were not detected in groups of mice. In a descriptive point of view, no difference in term of intensity and diversity of CD4+ T cell responses were observed between groups of mice vaccinated with constructs related to approach 1 or 2 and between mice vaccinated with similar constructs containing either glycine spacers or 2A cleavage sites.

HPV-specific and cross reactive CD4+ T cell responses to HPV18/33/35/45 E2 antigens were undetectable or limited in all groups of vaccinated mice. However, compared to NaCl control group, HPV16-specific CD4+ T cell responses were observed at low levels in all groups of mice.

Low levels of HPV45-specific and HPV35 cross-reactive CD4+ T cell responses to E6 antigens were detected in few mice from each vaccinated group.

HPV16/18-specific and HPV35 cross-reactive CD4+ T cell responses to E7 antigens were not observed in all groups of mice.

In summary, in CB6F1 mice, CD4+ T cells reactivity was higher to E1 and E2 antigens compared to E6 and E7 antigens.

Results in CD-1 Mouse Model

The Results in CD-1 mouse model are shown in FIGS. 31 and 32.

Assessment of HPV-Specific and Cross Reactive CD8+ T Cell Responses (FIG. 31): Compared to NaCl control group, each vaccinated group developed a strong and consistent HPV-E1 specific and cross reactive CD8+ T cell responses towards all high risk HPV types restimulated ex vivo with peptides pools. No major difference in term of specific and cross-reactive CD8+ T cell responses was detected between the vaccinated groups.

The HPV-specific and cross reactive CD8+ T cell responses raised against E2 protein from several HPV types were not consistent. Not all vaccinated mice from the different groups were able to induce specifically CD8+ T cell responses against HPV16/18 E2 proteins encoded in the vaccines. However, HPV45-specific CD8+ T cell responses were induced in the majority of mice vaccinated with the constructs related to approach 1 (gly or 2A version).

HPV E6 antigens were poorly immunogenic in this strain of mice. HPV18-specific CD8+ T cell responses were only detected in few mice vaccinated with the constructs containing the glycine. No cross reactivity were observed against HPV E6 antigens.

HPV16/18-specific CD8+ T cell responses were detected at high level in few mice vaccinated with ChAd155-HPV constructs related to approach 2 (gly or 2A version). Cross-reactivity to HPV35E7 sequence was inconsistent and limited.

In summary, in CD-1 mice, CD8+ T cells reactivity was higher to E1, E2 antigens compared to E6-E7 antigens.

Assessment of HPV-Specific and Cross Reactive CD4+ T Cell Responses (FIG. 32):

Compared to NaCl control group, each vaccinated group developed low levels of HPV-E1 specific and cross reactive CD4+ T cell responses towards all high risk HPV types restimulated ex vivo with peptides pools. Mice vaccinated with the constructs related to approach 2 containing 2A cleavage sites responded more consistently to HPV E1 antigens than other groups of vaccinated mice.

In all group of mice, HPV-E2 specific and cross-reactive CD4+ T cell responses to all high risk HPV types tested ex vivo were detected at low levels. Higher HPV E2 CD4+ T cell responses were observed in both groups of mice vaccinated with the constructs containing 2A cleavage sites compared to the mice vaccinated with the constructs containing glycine spacers.

HPVE6 sequences were poorly immunogenic in this strain of mice. However, inconstant and limited HPV45-specific and HPV35 cross-reactive CD4+ T cell responses to E6 antigens were observed.

HPV-specific and cross reactive CD4+ T cell responses to E7 antigens were not detected in this strain of mice.

In summary, CD4+ T cells reactivity was higher to E1 and E2 antigens compared to E6 and E7 antigens.

Results in HLA A2/DR1 tg Mouse Model

The Results in HLA A2/DR1 mouse model are shown in FIGS. 33 to 36.

Assessment of HPV-Specific and Cross Reactive CD8+ T Cell Responses (FIG. 33-34):

Strong and consistent HPV16/18-specific and HPV35 cross reactive CD8+ T cell responses to E1 antigens were detected in both vaccinated groups compared to NaCl control group. In addition, specific and cross reactive CD8+ T cell responses were detected inconsistently towards E1 of HPV35 and 45. Interestingly, CD8+ T cell responses were aborted or strongly decreased when splenocytes were restimulated ex-vivo with pool of peptides covering the predicted human CD8+ T cell epitopes enriched regions of HPVs E1. No major difference in term of HPV-specific and cross reactive CD8+ T cell responses was detected between approach 1 or 2.

No HPV16/18-specific CD8+ T cell responses were detected towards E2 in both vaccinated groups of mice compared to NaCl control group. Cross reactivity to HPV35 E2 were detected at low levels in few mice after ex vivo restimulation with pools of peptides covering the antigen-designed protein sequence of HPV35 E2. In addition, HPV45 E2-specific and cross reactive CD8+ T cell responses were also detected in some vaccinated mice. In this model, CD8+ T cells were not responding towards E2 of HPV33. No difference between mice vaccinated with approach 1 or 2 was observed.

Only strong HPV18-specific CD8+ T cell responses against E7 were detected in both vaccinated groups of mice compared to NaCl control group. The frequencies of CD8+ T cell responses to HPV18 E7 seemed to be higher in mice vaccinated with approach 1 than 2.

In summary, in HLA A2/DR1 tg mice, CD8+ T cells reactivity was higher to E1 & E7 compared to E2.

Assessment of HPV-Specific and Cross Reactive CD4+ T Cell Responses (FIG. 35-36):

HPV16/18/33 specific CD4+ T cell responses towards E1 antigens of HPV16/18/35 were not detected in both vaccinated groups compared to NaCl control group. HPV45 specific CD4+ T cell responses to E1 were only observed in few mice vaccinated with the constructs related to approach 2. No cross reactivity to E1 antigens were observed.

In this model, E2 and E7 antigens inserted into the vectors did not induced specific or cross reactive CD4+ T cell responses towards high risk HPV types tested.

In summary, in HLA A2/DR1 tg mice, CD4+ T cells reactivity was only detected to E1 sequences.

CONCLUSION

In summary, by analyzing simultaneously data collected from all the mouse models, both approaches were able to elicit HPV-specific CD8+/CD4+ T cell responses against all the 4 antigens (E1, E2, E6 & E7). As expected with adenovirus vectors, in all groups of mice vaccines were more potent to induced CD8+ T cell responses than CD4+ T cell responses. Regardless the approach and the mouse model, it obviously appeared than E1 was the dominant immunogen in HPV vaccines tested in this study.

Example 18: Alternative Antigen Design to Target 7 hrHPV Types

Alternative inserts were prepared in the same manner as in Examples 11 and 12. The following mutations were introduced into these inserts to eliminate the native activity of the wild-type E1, E2, E6 and E7 proteins:
E1=203-622+mut G482D;
E2=1-201+GGTGGS+285-365+mut K111A;
E6=11-150+mut C110R and mut F54R;
E7 HPV16=49-98+7-28+mutations C24G and E26Q/E7 HPV18=58-105+7-42+mutations C27G and E29Q.E1=203-622+mut G482D.

These constructs are presented in Table 29A and B below and in FIG. 37.

TABLE 29A

E2E7 insert

| Construct Identifier[1] | E2 | E7 |
|---|---|---|
| Gly_E2[7]E7[2] SEQ ID NO: 134 FIG. 37A | HPV16 (SEQ ID NO: 71) HPV18 (SEQ ID NO: 72) HPV31 (SEQ ID NO: 73) HPV33 (SEQ ID NO: 74) HPV45 (SEQ ID NO: 75) HPV52 (SEQ ID NO: 76) HPV58 (SEQ ID NO: 77) | HPV16 (SEQ ID NO: 61) HPV18 (SEQ ID NO: 62) |

[1]superscript numbers in construct identifiers indicate the number of HPV types; "Gly" indicates a 5xGly linker was placed between HPV antigenic peptides in the construct.

TABLE 29B

E1E6 inserts

| Construct Identifier[1] | E1 | E6 10 |
|---|---|---|
| Gly_E1E6[7] E1 SEQ ID NO: 135 FIG. 37B | HPV16 (SEQ ID NO: 51) HPV18 (SEQ ID NO: 52) | HPV16 (SEQ ID NO: 78) HPV18 (SEQ ID NO: 79) HPV31 (SEQ ID NO: 80) |
| Gly_E1[2]E6[7] SEQ ID NO: 136 FIG. 37C | | HPV33 (SEQ ID NO: 81) HPV45 (SEQ ID NO: 82) HPV52 (SEQ ID NO: 83) HPV58 (SEQ ID NO: 84) |

[1]superscript numbers in construct identifiers indicate the number of HPV types; "Gly" indicates a 5xGly linker was placed between HPV antigenic peptides in the construct.

Example 19: Design of SAM Constructs Encoding Antigenic HPV Polypeptides

The SAM platform is based on synthetic, self-amplifying mRNA derived from the alphavirus genome, expressing antigens of interest. The SAM constructs are evaluated for robust antigen productions and antigenicity and further tested for their immunogenicity and efficacy using in vivo models.

The design of the HPV-SAM constructs of FIG. 38 includes cloning the sequence encoding the antigenic HPV peptides, under the subgenomic promoter in the SAM vector. Modifications to the SAM HPV constructs were made including codon optimisation of the coding sequence for the antigen.

The SAM vector VEE TC-83 as described in WO2005/113782 was used as the background construct for cloning. This background construct has the nucleic acid sequence of SEQ ID NO: 142.

Nucleotide insert constructs Gly_E2[4], Gly_E2[3]E7[2] and Gly_E1[2]E6[7], as shown in FIG. 39 and Table 30 were prepared. The following mutations were introduced into these inserts to eliminate the native activity of the wild-type E1, E2, E6 and E7 proteins:
E1=203-622+mut G482D;
E2=1-201+GGTGGS+285-365+mut K111A;
E6=11-150+mut C110R and mut F54R;
E7 HPV16=49-98+7-28+mutations C24G and E26Q/E7 HPV18=58-105+7-42+mutations C27G and E29Q.E1=203-622+mut G482D.

Gly_E2[4], Gly_E2[3]E7[2] and Gly_E1[2]E6[7] were then cloned into SAM constructs (one construct for each insert) after nucleotide 7561 of SEQ ID NO:142.

SAM constructs having the sequence of SEQ ID NO:150, SEQ ID NO:152 and SEQ ID NO:154 have been designed and obtained.

TABLE 30A

E2 and E2E7 inserts

| Insert Identifier[1] | E2 | E7 |
|---|---|---|
| Gly_E2[4] SEQ ID NO: 143 FIG. 39A | HPV16 (SEQ ID NO: 71) HPV18 (SEQ ID NO: 72) HPV31 (SEQ ID NO: 73) HPV33 (SEQ ID NO: 74) | |
| Gly_E2"E7[2] SEQ ID NO: 145 FIG. 39B | HPV45 (SEQ ID NO: 75) HPV52 (SEQ ID NO: 76) HPV58 (SEQ ID NO: 77) | HPV16 (SEQ ID NO: 61) HPV18 (SEQ ID NO: 62) |

[1]superscript numbers in construct identifiers indicate the number of HPV types; "Gly" indicates a 5xGly linker was placed between HPV antigenic peptides in the construct.

TABLE 30B

E1E6 inserts

| Insert Identifier[1] | E1 | E6 5 |
|---|---|---|
| Gly_E1[2]E6[7] SEQ ID NO: 147 FIG. 39C | HPV16 (SEQ ID NO: 68) HPV18 (SEQ ID NO: 69) | HPV16 (SEQ ID NO: 78) HPV18 (SEQ ID NO: 79) HPV31 (SEQ ID NO: 80) HPV33 (SEQ ID NO: 81) HPV45 (SEQ ID NO: 82) HPV52 (SEQ ID NO: 83) HPV58 (SEQ ID NO: 84) |

[1]superscript numbers in construct identifiers indicate the number of HPV types; "Gly" indicates a 5xGly linker was placed between HPV antigenic peptides in the construct.

REFERENCES

Ambriović-Ristov A. et al.: Virology. (2003) 312(2):425-33 (2003)
Andersen et al, Cell. Mol. Neurobiol, 13:503-15 (1993)
Arbuthnot et al., Hum. Gene Ther., 7: 1503-14 (1996)
Aste-Amézaga et al., Hum. Gene Ther. 15(3):293-304 (2004)
Baldwin et al., Clin Cancer Research 9(14) (November 2003)
Boshart et al, Cell, 41:521-530 (1985)
Boukhvalova and Blanco. Curr Top Microbiol Immunol; 372: 347-58 (2013)
Brazolot-Millan et al., Proc. Natl. Acad. Sci., USA, 95:15553-8 (1998)
Chen et al., J. Bone Miner. Res., 11:654-64 (1996)
Colloca et al., *Sci Transl Med.;* 4(115): p. 115ra2 (2012)
Davidson et al., Cancer research 63(18):6032-41 (2003)
Davidson et al., Vaccine 22(21): 2722-2729 (2004)
Davis et al, J. Immunol, 160:870-876 (1998)
Donnelly M L et al., *J Gen Virol.;* 82(Pt 5): 1013-25 (2001)
Einstein et al., Comparison of the immunogenicity of the human papillomavirus (HPV)-16/18 vaccine and the HPV-6/11/16/18 vaccine for oncogenic non-vaccine types HPV-31 and HPV-45 in healthy women aged 18-45 years. Hum Vaccin. 7(12):1359-73 (2011).
Fallaux et al, Hum Gene Ther, 9:1909-1917 (1998)
Future II Study Group. "Prophylactic efficacy of a quadrivalent human papillomavirus (HPV) vaccine in women with virological evidence of HPV infection." Journal of Infectious Diseases 196(10): 1438-1446 (2007)
Garland et al., New England Journal of Medicine 356(19): 1928-1943 (2007)
Gossen et al, Proc. Natl. Acad. Sci. USA, 89:5547-5551 (1992)
Gossen et al, Science, 378:1766-1769 (1995)
Hansal et al, J. Immunol, 161:1063-8 (1998)
Harvey et al, Curr. Opin. Chem. Biol, 2:512-518 (1998)
Herrin et al., Hum Vaccin Immunother 10:3446-54 (2014)
Hilgers et al., Int. Arch. Allergy. Immunol., 79(4):392-6 (1986)
Hilgers et al., Immunology, 60(1):141-6 (1987)
Holowaty et al., J Natl Cancer Inst. 91: 252-8 (1999)
Hung et al., Therapeutic human papillomavirus vaccines: 8(4):421-39 (2008).
IARC Monograph, vol. 90, pp. 193-194, Table 26. Available at http://monographs (dot) iarc (dot) fr/ENG/Monographs/vol90/mono90 (dot) pdf (accessed 15 Aug. 2016)
Kaufmann et al., Int. J. Cancer 15; 92(2):285-93 (2001)
Kaufmann et al., *Clinical Cancer Research* 8(12):3676-3685 (2002)
Kensil et al., J. Immunology, 146: 431-437, (1991)
Kensil, Crit. Rev. Ther. Drug Carrier Syst., 12:1-55 (1996)
Krieg, Nature 374:546 (1995)
Lacaille-Dubois and Wagner, Phytomedicine vol 2 pp 363-386 (1996)
Li et al, Nature Biotech., 17:241-245 (1999)
Lin et al. J Formos Med Assoc.; 109(1):4-24 (2010)
Liu et al., Journal of virology 74(19): 9083-9089 (2000)
Lorin et al., PLOS One (9 Apr. 2015)
Magari et al, J. Clin. Invest., 100:2865-2872 (1997)
Malagon et al., Lancet Infectious Diseases 12(10):781-789 (October 2012)
McCluskie and Davis, J. Immunol., 161:4463-6 (1998)
Miyatake et al, J. Virol, 71:5124-32 (1997)
Molinier-Frenkel et al. *J. Biol. Chem.* 278:37175-37182 (2003)
Nicklin et al *Molecular Therapy* 12:384-393 (2005)
No et al, Proc. Natl. Acad. Sci. USA, 93:3346-3351 (1996)
Oh, Y. K. et al., Virology, 328(2): 266-273 (2004)
Pajot et al., EUR. J. Immunol. 2004 34: 3060-3069
Piccioli et al, Neuron, 15:373-84 (1995)
Piccioli et al, Proc. Natl. Acad. Sci. USA, 88:5611-5 (1991)
Pinto et al., Journal of Infectious Diseases, 188(2):327-338 (2003)
Prince et al., J. Gen. Virol.; 82: 2881-88 (2001).
Prince et al., J Virol.; 55(3): 517-20 (1985)
Richart R M. Obstet Gynecol; 75:131-3 (1990)
Roy et al. Virology 324: 361-372 (2004)
Roy et al. *Journal of Gene Medicine* 13:17-25 (2010)
Sandig et al, Gene Ther., 3:1002-9 (1996)
Schiffman et al., Virology, 337(1): 76-84 (2005)
Szymczak et al., Nature Biotechnology 22:589-594 (2004).
Solomon. The 1988 Bethesda System for reporting cervical/vaginal cytologic diagnoses. Human Pathology (7):704-8 (1990).
Stein et al, Mol. Biol. Rep., 24:185-96 (1997)
Tatsis and Ertl, *Molecular Therapy,* 10:616-629 (2004)
Tobery et al., Vaccine, 2/(13):1539-1547 (2003)
van Kuppeveld et al., FEMS Immunology & Medical Microbiology, 34(3): 201-208. (2002)
Velders et al., Cancer research, 61(21):7861-7867 (2001)
Vitelli et al. PLOS One, 8(e55435):1-9 (2013)
Walboomers et al., J Pathol; 189:12-19 (1999)
Wang et al, Gene Ther., 4:432-441 (1997a)
Wang et al, Nat. Biotech., 15:239-243 (1997b)
Wheeler et al., 4-year end-of-study analysis of the randomised, double-blind PATRICIA trial. Lancet Oncology, 13:100-110 (2012)
WHO/IC summary report, 2010, available at www(dot)hpvcentre(dot)net

SEQUENCE LISTING (154 sequences)

SEQ ID NO: 1 - protein, 578 aa, Simian adenovirus
MKRTKTSDESFNPVYPYDTESGPPSVPFLTPPFVSPDGFQESPPGVLSLNLAEPLVTSHGMLALKMGSGLSLDDAGNLTSQDITTASPPLKKTKTNLSLETSSPLTVSTSGALTVAAAAPLAVAGTSLTMQSEAPLTVQDAKLTLATKGPLTVSEGKLALQTSAPLTAADSSTLTVSATPPLSTSNGSLGIDMQAPIYTTNGKLGLNFGAPLHVVDSLNALTVVTGQGLTINGTALQTRVSGALNYDTSGNLELRAAGGMRVDANGQLILDVAYPFDAQNNLSLRLGQGPLFVNSAHNLDVNYNRGLYLFTSGNTKKLEVNIKTAKGLIYDDTAIAINAGDGLQFDSGSDTNPLKTKLGLGLDYDSSRAIIAKLGTGLSFDNTGAITVGNKNDDKLTLWTTPDPSPNCRIYSEKDAKFTLVLTKCGSQVLASVSVLSVKGSLAPISGTVTSAQIVLRFDENGVLLSNSSLDPQYWNYRKGDLTEGTAYTNAVGFMPNLTAYPKTQSQTAKSNIVSQVYLNGDKSKPMTLTITLNGTNETGDATVSTYSMSFSWNWNGSNYINETFQTNSFTFSYIAQE

SEQ ID NO: 2 - DNA, 1734 bp, Simian adenovirus
atgaagcgcaccaaaacgtctgacgagagcttcaaccccgtgtacccctatgacacggaaagcggccctccctccgtccctttcctcacccctcccttcgtgtctcccgatggattccaagaaagtccccccggggtcctgtctctgaacctggccgagcccctggtcacttcccacggcatgctcgccctgaaaatgggaagtggcctctccctggacgacgctggcaacctcacctctcaagatatcaccaccgctagccctcccctcaaaaaaaccaagaccaacctcagcctagaaacctcatcccccctaactgtgagcacctcaggcgccctcaccgtagcagccgccgctcccctggcggtggccggcacctccctcaccatgcaatcagaggcccccctgacagtacaggatgcaaaactcaccctggccaccaaaggccccctgaccgtgtctgaaggcaaactggccttgcaaacatcggccccgctgacggccgctgacagcagcaccctcacagtcagtgccacaccaccccttagcacaagcaatggcagcttgggtattgacatgcaagcccccatttacaccaccaatggaaaactaggacttaactttggcgctcccctgcatgtggtagacagcctaaatgcactgactgtagttactggccaaggtcttacgataaacggaacagccctacaaactagagtctcaggtgccctcaactatgacacatcaggaaacctagaattgagagctgcagggggtatgcgagttgatgcaaatggtcaacttatccttgatgtagcttacccatttgatgcacaaaacaatctcagccttaggcttggacagggacccctgtttgttaactctgcccacaacttggatgttaactacaacagaggcctctacctgttcacatctggaaataccaaaaagctagaagttaatatcaaaacagccaagggtctcatttatgatgacactgctatagcaatcaatgcgggtgatgggctacagtttgactcaggctcagatacaaatccattaaaaactaaacttggattaggactggattatgactccagcagagccataattgctaaactgggaactggcctaagctttgacaacacaggtgccatcacagtaggcaacaaaaatgatgacaagcttaccttgtggaccacaccagacccatcccctaactgtagaatctattcagagaaagatgctaaattcacacttgttttgactaaatgcggcagtcaggtgttggccagcgtttctgttttatctgtaaaaggtagccttgcgcccatcagtggcacagtaactagtgctcagattgtcctcagatttgatgaaaatggagttctactaagcaattcttcccttgaccctcaatactggaactacagaaaaggtgaccttacagagggcactgcatataccaacgcagtgggatttatgcccaacctcacagcatacccaaaaacacagagccaaactgctaaaagcaacattgtaagtcaggtttacttgaatggggacaaatccaaacccatgaccctcaccattaccctcaatggaactaatgaaacaggagatgccacagtaagcacttactccatgtcattctcatggaactggaatggaagtaattacattaatgaaacgttccaaaccaactccttcaccttctcctacatcgcccaagaa

SEQ ID NO: 3 - protein, 593 aa, Simian adenovirus
MRRAAMYQEGPPPSYESVVGAAAAAPSSPFASQLLEPPYVPPRYLRPTGGRNSIRYSELAPLFDTTRVYLVDNKSADVASLNYQNDHSNFLTTVIQNNDYSPSEASTQTINLDDRSHWGGDLKTILHTNMPNVNEFMFTNKFKARVMVSRSHTKEDRVELKYEWVEFELPEGNYSETMTIDLMNNAIVEHYLKVGRQNGVLESDIGVKFDTRNFRLGLDPVTGLVMPGVYTNEAFHPDIILLPGCGVDFTYSRLSNLLGIRKRQPFQEGFRITYEDLEGGNIPALLDVEAYQDSLKENEAGQEDTAPAASAAAEQGEDAADTAAADGAEADPAMVVEAPEQEEDMNDSAVRGDTFVTRGEEKQAEAEAAAEEKQLAAAAAAAALAAAEAESEGTKPAKEPVIKPLTEDSKKRSYNLLKDSTNTAYRSWYLAYNYGDPSTGVRSWTLLCTPDVTCGSEQVYWSLPDMMQDPVTFRSTRQVSNFPVVGAELLPVHSKSFYNDQAVYSQLIRQFTSLTHVFNRFPENQILARPPAPTITTVSENVPALTDHGTLPLRNSIGGVQRVTVTDARRRTCPYVYKALGIVSPRVLSSRTF

SEQ ID NO: 4 - DNA, 1779 bp, Simian adenovirus
atgcggcgcgcggcgatgtaccaggagggacctcctccctcttacgagagcgtggtgggcgcggcggcggcggcgccctcttctccctttgcgtcgcagctgctggagccgccgtacgtgcctccgcgctacctgcggcctacgggggggagaaacagcatccgttactcggagctggcgcccctgttcgacaccacccgggtgtacctggtggacaacaagtcggcggacgtggcctccctgaactaccagaacgaccacagcaattttttgaccacggtcatccagaacaatgactacagcccgagcgaggccagcacccagaccatcaatctggatgaccggtcgcactggggcggcgacctgaaaaccatcctgcacaccaacatgcccaacgtgaacgagttcatgttcaccaataagttcaaggcgcgggtgatggtgtcgcgctcgcacaccaaggaagaccgggtggagctgaagtacgagtgggtggagttcgagctgccagagggcaactactccgagaccatgaccattgacctgatgaacaacgcgatcgtggagcactatctgaaagtgggcaggcagaacggggtcctggagagcgacatcggggtcaagttcgacaccaggaacttccgcctggggctggaccccgtgaccgggctggttatgcccggggtgtacaccaacgaggccttccatcccgacatcatcctgctgcccggctgcggggtggacttcacttacagccgcctgagcaacctcctgggcatccgcaagcggcagcccttccaggagggcttcaggatcacctacgaggacctggaggggggcaacatccccgcgctcctcgatgtggaggcctaccaggatagcttgaaggaaaatgaggcgggacaggaggataccgcccccgccgcctccgccgccgccgagcagggcgaggatgctgctgacaccgcggccgcggacggggcagaggccgaccccgctatggtggtggaggctcccgagcaggaggaggacatgaatgacagtgcggtgcgcggagacaccttcgtcacccggggggaggaaaagcaagcggaggccgaggccgcggccgaggaaaagcaactggcggcagcagcggcggcggcggcgttggccgcggcggaggctgagtctgaggggaccaagcccgccaaggagcccgtgattaagcccctgaccgaagatagcaagaagcgcagttacaacctgctcaaggacagcaccaacaccgcgtaccgcagctggtacctggcctacaactacggcgacccgtcgacgggggtgcgctcctggaccctgctgtgcacgccggacgtgacctgcggctcggagcaggtgtactggtcgctgcccgacatgatgcaagaccccgtgaccttccgctccacgcggcaggtcagcaacttcccggtggtgggcgccgagctgctgcccgtgcactccaagagcttctacaacgaccaggccgtctactcccagctcatccgccagttcacctctctgacccacgtgttcaatcgctttcctgagaaccagattctggcgcgcccgcccgcccccaccatcaccaccgtcagtgaaaacgttcctgctctcacagatcacgggacgctaccgctgcgcaacagcatcggaggagtccagcgagtgaccgttactgacgccagacgccgcacctgcccctacgtttacaaggccttgggcatagtctcgccgcgcgtcctttccagccgcactttt

SEQ ID NO: 5 - protein, 964 aa, Simian adenovirus
MATPSMMPQWSYMHISGQDASEYLSPGLVQFARATDSYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWEQEETQTAEEAQDEEEDEAEAEEEMPQEEQAPVKKTHVYAQAPLSGEKITKDGLQIGTDATATEQKPIYADPTFQPEPQIGESQWNEADASVAGGRVLKKTTPMKPCYGSYARPTNANGGQGVLVEKDGGKMESQVDMQFFSTSENARNEANNIQPKLVLYSEDVHMETPDTHISYKPAKSDDNSKVMLGQQSMPNRPNYIGFRDNFIGLMYYNSTGNMGVLAGQASQLNAVVDLQDRNTELSYQLLLDSMGDRTRYFSMWNQAVDSYDPDVRIIENHGTEDELPNYCFPLGGIGVTDTYQAIKTNGNGNGGGNTTWTKDETFADRNEIGVGNNFAMEINLSANLWRNFLYSNVALYLPDKLKYNPSNVEISDNPNTYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFESICLYATFFPMAHNTASTLEAMLRNDTNDQSFNDYLSAANMLYPIPANATNVPISIPSRNWAAFRGWAFTRLKTKETPSLGSGFDPYYTYSGSIPYLDGTFYLNHTFKKVSVTFDSSVSWPGNDRLLTPNEFEIKRSVDGEGYNVAQCNMTKDWFLIQMLANYNIGYQGFYIPESYKDRMYSFFRNFQPMSRQVVDETKYKDYQQVGIIHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYVLFEVFDVVRVHQPHRGVIETVYLRTPFSAGNATT

SEQ ID NO: 6 - DNA, 2880 bp, Simian adenovirus
atggcgaccccatcgatgatgccgcagtggtcgtacatgcacatctcgggccaggacgcctcggagtacctgagccccgggctggtgcagttcgcccgcgccaccgagagctacttcagcctgagtaacaagtttaggaaccccacggtggcgcccacgcacgatgtgaccaccgaccggtctcagcgcctgacgctgcggttcattcccgtggaccgcgaggacaccgcgtactcgtacaaggcgcggttcaccctggccgtgggcgacaaccgcgtgctggacatggcctccacctactttgacatccgcggggtgctggaccggggtcccactttcaagccctactctggcaccgcctacaactccctggcccccaagggcgctcccaactcctgcgagtgggagcaagaggaaactcaggcagttgaagaagcagcagaagaggaagaagaagatgctgacggtcaagctgaggaagagcaagcagctaccaaaaagactcatgtatatgctcaggctcccctttctggcgaaaaaattagtaaagatggtctgcaaataggaacggacgctacagctacagaacaaaaacctatttatgcagaccctacattccagcccgaaccccaaatcggggagtcccagtggaatgaggcagatgctacagtcgccggcggtagagtgctaaagaaatctactcccatgaaaccatgctatggttcctatgcaagacccacaaatgctaatggaggtcagggtgtactaacggcaaatgcccagggacagctagaatctcaggttgaaatgcaattcttttcaacttctgaaaacgcccgtaacgaggctaacaacattcagcccaaattggtgctgtatagtgaggatgtgcacatggagaccccggatacgcacctttcttacaagcccgcaaaaagcgatgacaattcaaaaatcatgctgggtcagcagtccatgcccaacagacctaattacatcggcttcagagacaactttatcggcctcatgtattacaatagcactggcaacatgggagtgcttgcaggtcaggcctctcagttgaatgcagtggtggacttgcaagacagaaacacagaactgtcctaccagctcttgcttgattccatgggtgacagaaccagatacttttccatgtggaatcaggcagtggacagttatgacccagatgttagaattattgaaaatcatggaactgaagacgagctccccaactattgtttccctctgggtggcataggggtaactgacacttaccaggctgttaaaaccaacaatggcaataacgggggccaggtgacttggacaaaagatgaaacttttgcagatcgcaatgaaataggggtgggaaacaatttcgctatggagatcaacctcagtgccaacctgtggagaaacttcctgtactccaacgtggcgctgtacctaccagacaagcttaagtacaacccctccaatgtggacatctctgacaaccccaacacctacgattacatgaacaagcgagtggtggccccggggctggtggactgctacatcaacctgggcgcgcgctggtcgctggactacatggacaacgtcaaccccttcaaccaccaccgcaatgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggtaacgatctcagggtggacggggccagcatcaagttcgagagcatctgcctctacgccaccttcttccccatggcccacaacacggcctccacgctcgaggccatgctcaggaacgacaccaacgaccagtccttcaatgactacctctccgccgccaacatgctctaccccatacccgccaacgccaccaacgtccccatctccatcccctcgcgcaactgggcggccttccgcggctgggccttcacccgcctcaagaccaaggagaccccctccctgggctcgggattcgacccctactacacctactcgggctccattccctacctggacggcaccttctacctcaaccacactttcaagaaggtctcggtcaccttcgactcctcggtcagctggccgggcaacgaccgtctgctcacccccaacgagttcgagatcaagcgctcggtcgacggggagggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctatccgctcataggcaagaccgcggtcgacagcatcacccagaaaaagttcctctgcgaccgcaccctctggcgcatccccttctccagcaacttcatgtccatgggtgcgctctcggacctgggccagaacttgctctacgccaactccgcccacgccctcgacatgaccttcgaggtcgaccccatggacgagcccacccttctctatgttctgttcgaagtctttgacgtggtccgggtccaccagccgcaccgcggcgtcatcgagaccgtgtacctgcgtacgcccttctcggccggcaacgccaccacc

SEQ ID NO: 7 - DNA, 37912 bp, Artificial
  synthetic polynucleotide
catcatcaataatataccttattttggattgaagccaatatgataatgagatgggcggcgcggggcggggcgcggggcgggaggcgggtttgggggcgggccggcgggcggggcggtgtggcggaagtggactttgtaagtgtggcggatgtgacttgctagtgccgggcgcggtaaaagtgacgttttccgtgcgcgacaacgcccccgggaagtgacatttttcccgcggtttttaccggatgttgtagtgaatttgggcgtaaccaagtaagatttggccattttcgcgggaaaactgaaacggggaagtgaaatctgattaattttgcgttagtcataccgcgtaatatttgtctagggccgagggactttggccgattacgtggaggactcgcccaggtgttttttgaggtgaatttccgcgttccgggtcaaagtctgcgttttattattataggatatcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccgcggccgggaacggtgcattggaacgcggattccccgtgccaagagtgagatcttccgtttatctaggtaccgggccccccctcgaggtcgacggtatcgataagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctaaccaggagctatttaatggcaacagttaaccagctggtacgcaaaccacgtgctcgcaaagttgcgaaaagcaacgtgcctgcgctggaagcatgcccgcaaaaacgtggcgtatgtactcgtgtatatactaccactcctaaaaaaccgaactccgcgctgcgtaaagtatgccgtgttcgtctgactaacggtttcgaagtgacttcctacatcggtggtgaaggtcacaacctgcaggagcactccgtgatcctgatccgtggcggtcgtgttaaagacctcccgggtgttcgttaccacaccgtacgtggtgcgcttgactgctccggcgttaaagaccgtaagcaggctcgttccaagtatggcgtgaagcgtcctaaggcttaatggtagatctgatcaagagacaggatgacggtcgtttcgcatgcttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccgggctcgatcccctcggggggaatcagaattcagtcgacagcggccgcgatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggccgatcagcgatcgctgaggtgggtgagtgggcgtggcctggggtggtcatgaaaatatataagttgggggtcttagggtctctttatttgtgttgcagagaccgccggagccatgagcgggagcagcagcagcagcagtagcagcagcgccttggatggcagcatcgtgagcccttatttgacgacgcggatgccccactgggccggggtgcgtcagaatgtgatgggctccagcatcgacggccgacccgtcctgcccgcaaattccgccacgctgacctatgcgaccgtcgcggggacgccgttggacgccaccgccgccgccgccgccaccgcagccgcctcggccgtgcgcagcctggccacggactttgcattcctgggaccactggcgacaggggctacttctcgggccgctgctgccgccgttcgcgatgacaagctgaccgccctgctggcgcagttggatgcgcttactcgggaactgggtgacctttctcagcaggtcatggccctgcgccagcaggtctcctccctgcaagctggcgggaatgcttctcccacaaatgccgtttaagataaataaaaccagactctgtttggattaaagaaaagtagcaagtgcattgctctctttatttcataattttccgcgcgcgataggccctagaccagcgttctcggtcgttgagggtgcggtgtatcttctccaggacgtggtagaggtggctctggacgttgagatacatgggcatgagcccgtcccgggggtggaggtagcaccactgcagagcttcatgctccggggtggtgttgtagatgatccagtcgtagcaggagcgctgggcatggtgcctaaaaatgtccttcagcagcaggccgatggccagggggaggcccttggtgtaagtgtttacaaaacggttaagttgggaagggtgcattcggggagagatgatgtgcatcttggactgtatttttagattggcgatgtttccgcccagatcccttctgggattcatgttgtgcaggaccaccagtacagtgtatccggtgcacttggggaatttgtcatgcagcttagagggaaaagcgtggaagaacttggagacgcctttgtggcctcccagattttccatgcattcgtccatgatgatggcaatgggcccgcgggaggcagcttgggcaaagatatttctggggtcgctgacgtcgtagttgtgttccagggtgaggtcgtcataggccatttttacaaagcgcgggcggagggtgcccgactgggggatgatggtcccctctggccctggggcgtagttgccctcgcagatctgcatttcccaggccttaatctcggaggggggaatcatatccacctgcggggcgatgaagaaaacggtttccggagccggggagattaactgggatgagagcaggtttctaagcagctgtgattttccacaaccggtgggcccataaataacacctataaccggttgcagctggtagtttagagagctgcagctgccgtcgtcccggaggaggggggccacctcgttgagcatgtccctgacgcgcatgttctccccgaccagatccgccagaaggcgctcgccgcccagggacagcagctcttgcaaggaagcaaagtttttcagcggcttgaggccgtccgccgtgggcatgtttttcagggtctggctcagcagctccaggcggtcccagagctcggtgacgtgctctacggcatctctatccagcatatctcctcgtttcgcgggttggggcgactttcgctgtagggcaccaagcggtggtcgtccagcggggccagagtcatgtccttccatgggcgcagggtcctcgtcagggtggtctgggtcacggtgaaggggtgcgctccgggctgagcgcttgccaaggtgcgcttgaggctggttctgctggtgctgaagcgctgccggtcttcgccctgcgcgtcggccaggtagcatttgaccatggtgtcatagtccagcccctccgcggcgtgtcccttggcgcgcagcttgcccttggaggtggcgccgcacgaggggcagagcaggctcttgagcgcgtagagcttgggggcgaggaagaccgattcgggggagtaggcgtccgcgccgcagaccccgcacacggtctcgcactccaccagccaggtgagctcggggcgcgccgggtcaaaaaccaggtttcccccatgctttttgatgcgtttcttacctcgggtctccatgaggtggtgtccccgctcggtgacgaagaggctgtccgtgtctccgtagaccgacttgaggggtcttttctccaggggggtccctcggtcttcctcgtagaggaactcggaccactctgagacgaaggcccgcgtccaggccaggacgaaggaggctatgtgggaggggtagcggtcgttgtccactagggggtccaccttctccaaggtgtgaagacacatgtcgccttcctcggcgtccaggaaggtgattggcttgtaggtgtaggccacgtgaccgggggttcctgacgggggggtataaaagggggtgggggcgcgctcgtcgtcactctcttccgcatcgctgtctgcgagggccagctgctggggtgagtattccctctcgaaggcgggcatgacctccgcgctgaggttgtcagtttccaaaaacgaggaggatttgatgttcacctgtcccgaggtgatacctttgagggtacccgcgtccatctggtcagaaaacacgatctttttattgtccagcttggtggcgaacgacccgtagagggcgttggagagcagcttggcgatggagcgcagggtctggttcttgtccctgtcggcgcgctccttggccgcgatgttgagctgcacgtactcgcgcgcgacgcagcgccactcggggaagacggtggtgcgctcgtcgggcaccaggcgcacgcgccagccgcggttgtgcagggtgaccaggtccacgctggtggcgacctcgccgcgcaggcgctcgttggtccagcagagacggccgcccttgcgcgagcagaaggggggcagggggtcgagctgggtctcgtccggggggtccgcgtccacggtgaaaaccccggggcgcaggcgcgcgtcgaagtagtctatcttgcaaccttgcatgtccagcgcctgctgccagtcgcgggcggcgagcgcgcgctcgtaggggttgagcggcgggccccagggcatggggtgggtgagtgcggaggcgtacatgccgcagatgtcatagacgtagaggggctcccgcaggaccccgatgtaggtggggtagcagcggccgccgcggatgctggcgcgcacgtagtcatacagctcgtgcgagggggcgaggaggtcggggcccaggttggtgcgggcggggcgctccgcgcggaagacgatctgcctgaagatggcatgcgagttggaagagatggtggggcgctggaagacgttgaagctggcgtcctgcaggccgacggcgtcgcgcacgaaggaggcgtaggagtcgcgcagcttgtgtaccagctcggcggtgacctgcacgtcgagcgcgcagtagtcgagggtctcgcggatgatgtcatatttagcctgccccttctttttccacagctcgcggttgaggacaaactcttcgcggtctttccagtactcttggatcgggaaaccgtccggttccgaacggtaagagcctagcatgtagaactggttgacggcctggtaggcgcagcagcccttctccacggggagggcgtaggcctgcgcggccttgcggagcgaggtgtgggtcagggcgaaggtgtccctgaccatgactttgaggtactggtgcttgaagtcggagtcgtcgcagccgccccgctcccagagcgagaagtcggtgcgcttcttggagcgggggttgggcagagcgaaggtgacatcgttgaagaggattttgcccgcgcggggcatgaagttgcgggtgatgcggaagggccccggcacttcagagcggttgttgatgacctgggcggcgagcacgatctcgtcgaagccgttgatgttgtggcccacgatgtagagttccaggaagcggggccggccctttacggtgggcagcttctttagctcttcgtaggtgagctcctcgggcgaggcgaggccgtgctcggccagggcccagtccgcgaggtgcgggttgtctctgaggaaggacttccagaggtcgcgggccaggagggtctgcaggcggtctctgaaggtcctgaactggcggcccacggccattttttcgggggtgatgcagtagaaggtgagggggtcttgctgccagcggtcccagtcgagctgcagggcgaggtcgcgcgcggcggtgaccaggcgctcgtcgcccccgaatttcatgaccagcatgaagggcacgagctgctttccgaaggcccccatccaagtgtaggtctctacatcgtaggtgacaaagaggcgctccgtgcgaggatgcgagccgatcgggaagaactggatctcccgccaccagttggaggagtggctgttgatgtggtggaagtagaagtcccgtcgccgggccgaacactcgtgctggcttttgtaaaagcgagcgcagtactggcagcgctgcacgggctgtacctcatgcacgagatgcacctttcgcccgcgcacgaggaagccgaggggaaatctgagccccccgcctggctcgcggcatggctggttctcttctactttggatgcgtgtccgtctccgtctggctcctcgaggggtgttacggtggagcggaccaccacgccgcgcgagccgcaggtccagatatcggcgcgcggcggtcggagtttgatgacgacatcgcgcagctgggagctgtccatggtctggagctcccgcggcggcggcaggtcagccgggagttcttgcaggttcacctcgcagagtcgggccagggcgcggggcaggtctaggtggtacctgatctctaggggcgtgttggtggcggcgtcgatggcttgcaggagcccgcagccccggggggcgacgacggtgccccgcggggtggtggtggtggtggcggtgcagctcagaagcggtgccgcgggcgggcccccggaggtagggggggctccggtcccgcgggcaggggcggcagcggcacgtcggcgtggagcgcgggcaggagttggtgctgtgcccggaggttgctggcgaaggcgacgacgcggcggttgatctcctggatctggcgcctctgcgtgaagacgacgggcccggtgagcttgaacctgaaagagagttcgacagaatcaatctcggtgtcattgaccgcggcctggcgcaggatctcctgcacgtctcccgagttgtcttggtaggcgatctcggccatgaactgctcgatctcttcctcctggaggtctccgcgtccggcgcgttccacggtggccgccaggtcgttggagatgcgccccatgagctgcgagaaggcgttgagtccgccctcgttccagactcggctgtagaccacgcccccctggtcatcgcgggcgcgcatgaccacctgcgcgaggttgagctccacgtgccgcgcgaagacggcgtagttgcgcagacgctggaagaggtagttgagggtggtggcggtgtgctcggccacgaagaagttcatgacccagcggcgcaacgtggattcgttgatgtcccccaaggcctccagccgttccatggcctcgtagaagtccacggcgaagttgaaaaactgggagttgcgcgccgacacggtcaactcctcctccagaagacggatgagctcggcgacggtgtcgcgcacctcgcgctcgaaggctatggggatctcttcctccgctagcatcaccacctcctcctcttcctcctcttctggcacttccatgatggcttcctcctcttcggggggtggcggcggcggcggtgggggagggggcgctctgcgccggcggcggcgcaccgggaggcggtccacgaagcgcgcgatcatctccccgcggcggcggcgcatggtctcggtgacggcgcggccgttctcccgggggcgcagttggaagacgccgccggacatctggtgctggggcgggtggccgtgaggcagcgagacggcgctgacgatgcatctcaacaattgctgcgtaggtacgccgccgagggacctgagggagtccatatccaccggatccgaaaacctttcgaggaaggcgtctaaccagtcgcagtcgcaaggtaggctgagcaccgtggcgggcggcggggggtggggggagtgtctggcggaggtgctgctgatgatgtaattgaagtaggcggacttgacacggcggatggtcgacaggagcaccatgtccttgggtccggcctgctggatgcggaggcggtcggctatgccccaggcttcgttctggcatcggcgcaggtccttgtagtagtcttgcatgagcctttccaccggcacctcttctccttcctcttctgcttcttccatgtctgcttcggccctggggcggcgccgcgcccccctgccccccatgcgcgtgaccccgaaccccctgagcggttggagcagggccaggtcggcgacgacgcgctcggccaggatggcctgctgcacctgcgtgagggtggtttggaagtcatccaagtccacgaagcggtggtaggcgcccgtgttgatggtgtaggtgcagttggccatgacggaccagttgacggtctggtggcccggttgcgacatctcggtgtacctgagtcgcgagtaggcgcgggagtcgaagacgtagtcgttgcaagtccgcaccaggtactggtagcccaccaggaagtgcggcggcggctggcggtagaggggccagcgcagggtggcgggggctccgggggccaggtcttccagcatgaggcggtggtaggcgtagatgtacctggacatccaggtgatacccgcggcggtggtggaggcgcgcgggaagtcgcgcacccggttccagatgttgcgcaggggcagaaagtgctccatggtaggcgtgctctgtccagtcagacgcgcgcagtcgttgatactctagaccagggaaaacgaaagccggtcagcgggcactcttccgtggtctggtgaatagatcgcaagggtatcatggcggagggcctcggttcgagccccgggtccgggccggacggtccgccatgatccacgcggttaccgcccgcgtgtcgaacccaggtgtgcgacgtcagacaacggtggagtgttccttttggcgtttttctggccgggcgccggcgccgcgtaagagactaagccgcgaaagcgaaagcagtaagtggctcgctccccgtagccggagggatccttgctaagggttgcgttgcggcgaaccccggttcgaatcccgtactcgggccggccggacccgcggctaaggtgttggattggcctccccctcgtataaagaccccgcttgcggattgactccggacacggggacgagccccttttatttttgctttccccagatgcatccggtgctgcggcagatgcgccccccgccccagcagcagcaacaacaccagcaagagcggcagcaacagcagcgggagtcatgcagggccccctcacccaccctcggcgggccggccacctcggcgtccgcggccgtgtctggcgcctgcggcggcggcggggggccggctgacgaccccgaggagcccccgcggcgcagggccagacactacctggacctggaggagggcgagggcctggcgcggctgggggcgccgtctcccgagcgccacccgcgggtgcagctgaagcgcgactcgcgcgaggcgtacgtgcctcggcagaacctgttcagggaccgcgcgggcgaggagcccgaggagatgcgggacaggaggttcagcgcagggcgggagctgcggcaggggctgaaccgcgagcggctgctgcgcgaggaggactttgagcccgacgcgcggacggggatcagccccgcgcgcgcgcacgtggcggccgccgacctggtgacggcgtacgagcagacggtgaaccaggagatcaacttccaaaagagtttcaacaaccacgtgcgcacgctggtggcgcgcgaggaggtgaccatcgggctgatgcacctgtgggactttgtaagcgcgctggtgcagaaccccaacagcaagcctctgacggcgcagctgttcctgatagtgcagcacagcagggacaacgaggcgtttagggacgcgctgctgaacatcaccgagcccgagggtcggtggctgctggacctgattaacatcctgcagagcatagtggtgcaggagcgcagcctgagcctggccgacaaggtggcggccatcaactactcgatgctgagcctgggcaagttttacgcgcgcaagatctaccagacgccgtacgtgcccatagacaaggaggtgaagatcgacggtttttacatgcgcatggcgctgaaggtgctcaccctgagcgacgacctgggcgtgtaccgcaacgagcgcatccacaaggccgtgagcgtgagccggcggcgcgagctgagcgaccgcgagctgatgcacagcctgcagcgggcgctggcgggcgccggcagcggcgacagggaggcggagtcctacttcgatgcgggggcggacctgcgctgggcgcccagccggcgggccctggaggccgcgggggtccgcgaggactatgacgaggacggcgaggaggatgaggagtacgagctagaggagggcgagtacctggactaaaccgcgggtggtgtttccggtagatgcaagacccgaacgtggtggacccggcgctgcgggcggctctgcagagccagccgtccggccttaactcctcagacgactggcgacaggtcatggaccgcatcatgtcgctgacggcgcgtaacccggacgcgttccggcagcagccgcaggccaacaggctctccgccatcctggaggcggtggtgcctgcgcgctcgaaccccacgcacgagaaggtgctggccatagtgaacgcgctggccgagaacagggccatccgcccggacgaggccgggctggtgtacgacgcgctgctgcagcgcgtggcccgctacaacagcggcaacgtgcagaccaacctggaccggctggtgggggacgtgcgcgaggcggtggcgcagcgcgagcgcgcggatcggcagggcaacctgggctccatggtggcgctgaatgccttcctgagcacgcagccggccaacgtgccgcgggggcaggaagactacaccaactttgtgagcgcgctgcggctgatggtgaccgagaccccccagagcgaggtgtaccagtcgggcccggactacttcttccagaccagcagacagggcctgcagacggtgaacctgagccaggctttcaagaacctgcgggggctgtggggcgtgaaggcgcccaccggcgaccgggcgacggtgtccagcctgctgacgcccaactcgcgcctgctgctgctgctgatcgcgccgttcacggacagcggcagcgtgtcccgggacacctacctggggcacctgctgaccctgtaccgcgaggccatcgggcaggcgcaggtggacgagcacaccttccaggagatcaccagcgtgagccgcgcgctggggcaggaggacacgagcagcctggaggcgactctgaactacctgctgaccaaccggcggcagaagattccctcgctgcacagcctgacctccgaggaggagcgcatcttgcgctacgtgcagcagagcgtgagcctgaacctgatgcgcgacggggtgacgcccagcgtggcgctggacatgaccgcgcgcaacatggaaccgggcatgtacgccgcgcaccggccttacatcaaccgcctgatggactacctgcatcgcgcggcggccgtgaaccccgagtactttaccaacgccatcctgaacccgcactggctcccgccgcccgggttctacagcgggggcttcgaggtcccggagaccaacgatggcttcctgtgggacgacatggacgacagcgtgttctccccgcggccgcaggcgctggcggaagcgtccctgctgcgtcccaagaaggaggaggaggaggaggcgagtcgccgccgcggcagcagcggcgtggcttctctgtccgagctgggggcggcagccgccgcgcgccccgggtccctgggcggcagcccctttccgagcctggtggggtctctgcacagcgagcgcaccacccgccctcggctgctgggcgaggacgagtacctgaataactccctgctgcagccggtgcgggagaaaaacctgcctcccgccttccccaacaacgggatagagagcctggtggacaagatgagcagatggaagacctatgcgcaggagcacagggacgcgcctgcgctccggccgcccacgcggcgccagcgccacgaccggcagcgggggctggtgtgggatgacgaggactccgcggacgatagcagcgtgctggacctgggagggagcggcaacccgttcgcgcacctgcgcccccgcctggggaggatgttttaaaaaaaaaaaaaaaaagcaagaagcatgatgcaaaaattaaataaaactcaccaaggccatggcgaccgagcgttggtttcttgtgttcccttcagtatgcggcgcgcggcgatgtaccaggagggacctcctccctcttacgagagcgtggtgggcgcggcggcggcggcgccctcttctccctttgcgtcgcagctgctggagccgccgtacgtgcctccgcgctacctgcggcctacgggggggagaaacagcatccgttactcggagctggcgcccctgttcgacaccacccgggtgtacctggtggacaacaagtcggcggacgtggcctccctgaactaccagaacgaccacagcaattttttgaccacggtcatccagaacaatgactacagcccgagcgaggccagcacccagaccatcaatctggatgaccggtcgcactggggcggcgacctgaaaaccatcctgcacaccaacatgcccaacgtgaacgagttcatgttcaccaataagttcaaggcgcgggtgatggtgtcgcgctcgcacaccaaggaagaccgggtggagctgaagtacgagtgggtggagttcgagctgccagagggcaactactccgagaccatgaccattgacctgatgaacaacgcgatcgtggagcactatctgaaagtgggcaggcagaacggggtcctggagagcgacatcggggtcaagttcgacaccaggaacttccgcctggggctggaccccgtgaccgggctggttatgcccggggtgtacaccaacgaggccttccatcccgacatcatcctgctgcccggctgcggggtggacttcacttacagccgcctgagcaacctcctgggcatccgcaagcggcagcccttccaggagggcttcaggatcacctacgaggacctggaggggggcaacatccccgcgctcctcgatgtggaggcctaccaggatagcttgaaggaaaatgaggcgggacaggaggataccgcccccgccgcctccgccgccgccgagcagggcgaggatgctgctgacaccgcggccgcggacggggcagaggccgaccccgctatggtggtggaggctcccgagcaggaggaggacatgaatgacagtgcggtgcgcggagacaccttcgtcacccggggggaggaaaagcaagcggaggccgaggccgcggccgaggaaaagcaactggcggcagcagcggcggcggcggcgttggccgcggcggaggctgagtctgaggggaccaagcccgccaaggagcccgtgattaagcccctgaccgaagatagcaagaagcgcagttacaacctgctcaaggacagcaccaacaccgcgtaccgcagctggtacctggcctacaactacggcgacccgtcgacgggggtgcgctcctggaccctgctgtgcacgccggacgtgacctgcggctcggagcaggtgtactggtcgctgcccgacatgatgcaagaccccgtgaccttccgctccacgcggcaggtcagcaacttcccggtggtgggcgccgagctgctgcccgtgcactccaagagcttctacaacgaccaggccgtctactcccagctcatccgccagttcacctctctgacccacgtgttcaatcgctttcctgagaaccagattctggcgcgcccgcccgcccccaccatcaccaccgtcagtgaaaacgttcctgctctcacagatcacgggacgctaccgctgcgcaacagcatcggaggagtccagcgagtgaccgttactgacgccagacgccgcacctgcccctacgtttacaaggccttgggcatagtctcgccgcgcgtcctttccagccgcactttttgagcaacaccaccatcatgtccatcctgatctcacccagcaataactccggctggggactgctgcgcgcgcccagcaagatgttcggaggggcgaggaagcgttccgagcagcaccccgtgcgcgtgcgcgggcacttccgcgccccctggggagcgcacaaacgcggccgcgcggggcgcaccaccgtggacgacgccatcgactcggtggtggagcaggcgcgcaactacaggcccgcggtctctaccgtggacgcggccatccagaccgtggtgcggggcgcgcggcggtacgccaagctgaagagccgccggaagcgcgtggcccgccgccaccgccgccgacccggggccgccgccaaacgcgccgccgcggccctgcttcgccgggccaagcgcacgggccgccgcgccgccatgagggccgcgcgccgcttggccgccggcatcaccgccgccaccatggccccccgtacccgaagacgcgcggccgccgccgccgccgccgccatcagtgacatggccagcaggcgccggggcaacgtgtactgggtgcgcgactcggtgaccggcacgcgcgtgcccgtgcgcttccgccccccgcggacttgagatgatgtgaaaaaacaacactgagtctcctgctgttgtgtgtatcccagcggcggcggcgcgcgcagcgtcatgtccaagcgcaaaatcaaagaagagatgctccaggtcgtcgcgccggagatctatgggcccccgaagaaggaagagcaggattcgaagccccgcaagataaagcgggtcaaaaagaaaaagaaagatgatgacgatgccgatggggaggtggagttcctgcgcgccacggcgcccaggcgcccggtgcagtggaagggccggcgcgtaaagcgcgtcctgcgccccggcaccgcggtggtcttcacgcccggcgagcgctccacccggactttcaagcgcgtctatgacgaggtgtacggcgacgaagacctgctggagcaggccaacgagcgcttcggagagtttgcttacgggaagcgtcagcgggcgctggggaaggaggacctgctggcgctgccgctggaccagggcaaccccacccccagtctgaagcccgtgaccctgcagcaggtgctgccgagcagcgcaccctccgaggcgaagcggggtctgaagcgcgagggcggcgacctggcgcccaccgtgcagctcatggtgcccaagcggcagaggctggaggatgtgctggagaaaatgaaagtagaccccggtctgcagccggacatcagggtccgccccatcaagcaggtggcgccgggcctcggcgtgcagaccgtggacgtggtcatccccaccggcaactcccccgccgccgccaccactaccgctgcctccacggacatggagacacagaccgatcccgccgcagccgcagccgcagccgccgccgcgacctcctcggcggaggtgcagacggacccctggctgccgccggcgatgtcagctccccgcgcgcgtcgcgggcgcaggaagtacggcgccgccaacgcgctcctgcccgagtacgccttgcatccttccatcgcgcccacccccggctaccgaggctatacctaccgcccgcgaagagccaagggttccacccgccgtccccgccgacgcgccgccgccaccacccgccgccgccgccgcagacgccagcccgcactggctccagtctccgtgaggaaagtggcgcgcgacggacacaccctggtgctgcccagggcgcgctaccaccccagcatcgtttaaaagcctgttgtggttcttgcagatatggccctcacttgccgcctccgtttcccggtgccgggataccgaggaggaagatcgcgccgcaggaggggtctggccggccgcggcctgagcggaggcagccgccgcgcgcaccggcggcgacgcgccaccagccgacgcatgcgcggcggggtgctgcccctgttaatccccctgatcgccgcggcgatcggcgccgtgcccgggatcgcctccgtggccttgcaagcgtcccagaggcattgacagacttgcaaacttgcaaatatggaaaaaaaaaccccaataaaaaagtctagactctcacgctcgcttggtcctgtgactattttgtagaatggaagacatcaactttgcgtcgctggccccgcgtcacggctcgcgcccgttcctgggacactggaacgatatcggcaccagcaacatgagcggtggcgccttcagttggggctctctgtggagcggcattaaaagtatcgggtctgccgttaaaaattacggctcccgggcctggaacagcagcacgggccagatgttgagagacaagttgaaagagcagaacttccagcagaaggtggtggagggcctggcctccggcatcaacggggtggtggacctggccaaccaggccgtgcagaataagatcaacagcagactggacccccggccgccggtggaggaggtgccgccggcgctggagacggtgtcccccgatgggcgtggcgagaagcgcccgcggcccgatagggaagagaccactctggtcacgcagaccgatgagccgcccccgtatgaggaggccctgaagcaaggtctgcccaccacgcggcccatcgcgcccatggccaccggggtggtgggccgccacacccccgccacgctggacttgcctccgcccgccgatgtgccgcagcagcagaaggcggcacagccgggcccgcccgcgaccgcctcccgttcctccgccggtcctctgcgccgcgcggccagcggcccccgcgggggggtcgcgaggcacggcaactggcagagcacgctgaacagcatcgtgggtctgggggtgcggtccgtgaagcgccgccgatgctactgaatagcttagctaacgtgttgtatgtgtgtatgcgccctatgtcgccgccagaggagctgctgagtcgccgccgttcgcgcgcccaccaccaccgccactccgcccctcaagatggcgaccccatcgatgatgccgcagtggtcgtacatgcacatctcgggccaggacgcctcggagtacctgagccccgggctggtgcagttcgcccgcgccaccgagagctacttcagcctgagtaacaagtttaggaaccccacggtggcgcccacgcacgatgtgaccaccgaccggtctcagcgcctgacgctgcggttcattcccgtggaccgcgaggacaccgcgtactcgtacaaggcgcggttcaccctggccgtgggcgacaaccgcgtgctggacatggcctccacctactttgacatccgcggggtgctggaccggggtcccactttcaagccctactctggcaccgcctacaactccctggcccccaagggcgctcccaactcctgcgagtgggagcaagaggaaactcaggcagttgaagaagcagcagaagaggaagaagaagatgctgacggtcaagctgaggaagagcaagcagctaccaaaaagactcatgtatatgctcaggctcccctttctggcgaaaaaattagtaaagatggtctgcaaataggaacggacgctacagctacagaacaaaaacctatttatgcagaccctacattccagcccgaaccccaaatcggggagtcccagtggaatgaggcagatgctacagtcgccggcggtagagtgctaaagaaatctactcccatgaaaccatgctatggttcctatgcaagacccacaaatgctaatggaggtcagggtgtactaacggcaaatgcccagggacagctagaatctcaggttgaaatgcaattcttttcaacttctgaaaacgcccgtaacgaggctaacaacattcagcccaaattggtgctgtatagtgaggatgtgcacatggagaccccggatacgcacctttcttacaagcccgcaaaaagcgatgacaattcaaaaatcatgctgggtcagcagtccatgcccaacagacctaattacatcggcttcagagacaactttatcggcctcatgtattacaatagcactggcaacatgggagtgcttgcaggtcaggcctctcagttgaatgcagtggtggacttgcaagacagaaacacagaactgtcctaccagctcttgcttgattccatgggtgacagaaccagatacttttccatgtggaatcaggcagtggacagttatgacccagatgttagaattattgaaaatcatggaactgaagacgagctccccaactattgtttccctctgggtggcataggggtaactgacacttaccaggctgttaaaaccaacaatggcaataacgggggccaggtgacttggacaaaagatgaaacttttgcagatcgcaatgaaataggggtgggaaacaatttcgctatggagatcaacctcagtgccaacctgtggagaaacttcctgtactccaacgtggcgctgtacctaccagacaagcttaagtacaacccctccaatgtggacatctctgacaaccccaacacctacgattacatgaacaagcgagtggtggccccggggctggtggactgctacatcaacctgggcgcgcgctggtcgctggactacatggacaacgtcaaccccttcaaccaccaccgcaatgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggtaacgatctcagggtggacggggccagcatcaagttcgagagcatctgcctctacgccaccttcttccccatggcccacaacacggcctccacgctcgaggccatgctcaggaacgacaccaacgaccagtccttcaatgactacctctccgccgccaacatgctctaccccatacccgccaacgccaccaacgtccccatctccatcccctcgcgcaactgggcggccttccgcggctgggccttcacccgcctcaagaccaaggagaccccctccctgggctcgggattcgacccctactacacctactcgggctccattccctacctggacggcaccttctacctcaaccacactttcaagaaggtctcggtcaccttcgactcctcggtcagctggccgggcaacgaccgtctgctcacccccaacgagttcgagatcaagcgctcggtcgacggggagggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctatccgctcataggcaagaccgcggtcgacagcatcacccagaaaaagttcctctgcgaccgcaccctctggcgcatccccttctccagcaacttcatgtccatgggtgcgctctcggacctgggccagaacttgctctacgccaactccgcccacgccctcgacatgaccttcgaggtcgaccccatggacgagcccacccttctctatgttctgttcgaagtctttgacgtggtccgggtccaccagccgcaccgcggcgtcatcgagaccgtgtacctgcgtacgcccttctcggccggcaacgccaccacctaaagaagcaagccgcagtcatcgccgcctgcatgccgtcgggttccaccgagcaagagctcagggccatcgtcagagacctgggatgcgggccctattttttgggcaccttcgacaagcgcttccctggctttgtctccccacacaagctggcctgcgccatcgtcaacacggccggccgcgagaccgggggcgtgcactggctggccttcgcctggaacccgcgctccaaaacatgcttcctctttgaccccttcggcttttcggaccagcggctcaagcaaatctacgagttcgagtacgagggcttgctgcgtcgcagcgccatcgcctcctcgcccgaccgctgcgtcaccctcgaaaagtccacccagaccgtgcaggggcccgactcggccgcctgcggtctcttctgctgcatgtttctgcacgcctttgtgcactggcctcagagtcccatggaccgcaaccccaccatgaacttgctgacgggggtgcccaactccatgctccagagcccccaggtcgagcccaccctgcgccgcaaccaggagcagctctacagcttcctggagcgccactcgccttacttccgccgccacagcgcacagatcaggagggccacctccttctgccacttgcaagagatgcaagaagggtaataacgatgtacacactttttttctcaataaatggcatctttttatttatacaagctctctggggtattcatttcccaccaccacccgccgttgtcgccatctggctctatttagaaatcgaaagggttctgccgggagtcgccgtgcgccacgggcagggacacgttgcgatactggtagcgggtgccccacttgaactcgggcaccaccaggcgaggcagctcggggaagttttcgctccacaggctgcgggtcagcaccagcgcgttcatcaggtcgggcgccgagatcttgaagtcgcagttggggccgccgccctgcgcgcgcgagttgcggtacaccgggttgcagcactggaacaccaacagcgccgggtgcttcacgctggccagcacgctgcggtcggagatcagctcggcgtccaggtcctccgcgttgctcagcgcgaacggggtcatcttgggcacttgccgccccaggaagggcgcgtgccccggtttcgagttgcagtcgcagcgcagcgggatcagcaggtgcccgtgcccggactcggcgttggggtacagcgcgcgcatgaaggcctgcatctggcggaaggccatctgggccttggcgccctccgagaagaacatgccgcaggacttgcccgagaactggtttgcggggcagctggcgtcgtgcaggcagcagcgcgcgtcggtgttggcgatctgcaccacgttgcgcccccaccggttcttcacgatcttggccttggacgattgctccttcagcgcgcgctgcccgttctcgctggtcacatccatctcgatcacatgttccttgttcaccatgctgctgccgtgcagacacttcagctcgccctccgtctcggtgcagcggtgctgccacagcgcgcagcccgtgggctcgaaagacttgtaggtcacctccgcgaaggactgcaggtacccctgcaaaaagcggcccatcatggtcacgaaggtcttgttgctgctgaaggtcagctgcagcccgcggtgctcctcgttcagccaggtcttgcacacggccgccagcgcctccacctggtcgggcagcatcttgaagttcaccttcagctcattctccacgtggtacttgtccatcagcgtgcgcgccgcctccatgcccttctcccaggccgacaccagcggcaggctcacggggttcttcaccatcaccgtggccgccgcctccgccgcgctttcgctttccgccccgctgttctcttcctcttcctcctcttcctcgccgccgcccactcgcagcccccgcaccacggggtcgtcttcctgcaggcgctgcaccttgcgcttgccgttgcgcccctgcttgatgcgcacgggcgggttgctgaagcccaccatcaccagcgcggcctcttcttgctcgtcctcgctgtccagaatgacctccggggagggggggttggtcatcctcagtaccgaggcacgcttctttttcttcctgggggcgttcgccagctccgcggctgcggccgctgccgaggtcgaaggccgagggctgggcgtgcgcggcaccagcgcgtcctgcgagccgtcctcgtcctcctcggactcgagacggaggcgggcccgcttcttcgggggcgcgcggggcggcggaggcggcggcggcgacggagacggggacgagacatcgtccagggtgggtggacggcgggccgcgccgcgtccgcgctcgggggtggtctcgcgctggtcctcttcccgactggccatctcccactgctccttctcctataggcagaaagagatcatggagtctctcatgcgagtcgagaaggaggaggacagcctaaccgccccctctgagccctccaccaccgccgccaccaccgccaatgccgccgcggacgacgcgcccaccgagaccaccgccagtaccaccctccccagcgacgcacccccgctcgagaatgaagtgctgatcgagcaggacccgggttttgtgagcggagaggaggatgaggtggatgagaaggagaaggaggaggtcgccgcctcagtgccaaaagaggataaaaagcaagaccaggacgacgcagataaggatgagacagcagtcgggcgggggaacggaagccatgatgctgatgacggctacctagacgtgggagacgacgtgctgcttaagcacctgcaccgccagtgcgtcatcgtctgcgacgcgctgcaggagcgctgcgaagtgcccctggacgtggcggaggtcagccgcgcctacgagcggcacctcttcgcgccgcacgtgccccccaagcgccgggagaacggcacctgcgagcccaacccgcgtctcaacttctacccggtcttcgcggtacccgaggtgctggccacctaccacatctttttccaaaactgcaagatccccctctcctgccgcgccaaccgcacccgcgccgacaaaaccctgaccctgcggcagggcgcccacatacctgatatcgcctctctggaggaagtgcccaagatcttcgagggtctcggtcgcgacgagaaacgggcggcgaacgctctgcacggagacagcgaaaacgagagtcactcgggggtgctggtggagctcgagggcgacaacgcgcgcctggccgtactcaagcgcagcatagaggtcacccactttgcctacccggcgctcaacctgccccccaaggtcatgagtgtggtcatgggcgagctcatcatgcgccgcgcccagcccctggccgcggatgcaaacttgcaagagtcctccgaggaaggcctgcccgcggtcagcgacgagcagctggcgcgctggctggagacccgcgaccccgcgcagctggaggagcggcgcaagctcatgatggccgcggtgctggtcaccgtggagctcgagtgtctgcagcgcttcttcgcggaccccgagatgcagcgcaagctcgaggagaccctgcactacaccttccgccagggctacgtgcgccaggcctgcaagatctccaacgtggagctctgcaacctggtctcctacctgggcatcctgcacgagaaccgcctcgggcagaacgtcctgcactccaccctcaaaggggaggcgcgccgcgactacatccgcgactgcgcctacctcttcctctgctacacctggcagacggccatgggggtctggcagcagtgcctggaggagcgcaacctcaaggagctggaaaagctcctcaagcgcaccctcagggacctctggacgggcttcaacgagcgctcggtggccgccgcgctggcggacatcatctttcccgagcgcctgctcaagaccctgcagcagggcctgcccgacttcaccagccagagcatgctgcagaacttcaggactttcatcctggagcgctcgggcatcctgccggccacttgctgcgcgctgcccagcgacttcgtgcccatcaagtacagggagtgcccgccgccgctctggggccactgctacctcttccagctggccaactacctcgcctaccactcggacctcatggaagacgtgagcggcgagggcctgctcgagtgccactgccgctgcaacctctgcacgccccaccgctctctagtctgcaacccgcagctgctcagcgagagtcagattatcggtaccttcgagctgcagggtccctcgcctgacgagaagtccgcggctccagggctgaaactcactccggggctgtggacttccgcctacctacgcaaatttgtacctgaggactaccacgcccacgagatcaggttctacgaagaccaatcccgcccgcccaaggcggagctcaccgcctgcgtcatcacccaggggcacatcctgggccaattgcaagccatcaacaaagcccgccgagagttcttgctgaaaaagggtcggggggtgtacctggacccccagtccggcgaggagctaaacccgctacccccgccgccgccccagcagcgggaccttgcttcccaggatggcacccagaaagaagcagcagccgccgccgccgccgcagccatacatgcttctggaggaagaggaggaggactgggacagtcaggcagaggaggtttcggacgaggagcaggaggagatgatggaagactgggaggaggacagcagcctagacgaggaagcttcagaggccgaagaggtggcagacgcaacaccatcgccctcggtcgcagccccctcgccggggcccctgaaatcctccgaacccagcaccagcgctataacctccgctcctccggcgccggcgccacccgcccgcagacccaaccgtagatgggacaccacaggaaccggggtcggtaagtccaagtgcccgccgccgccaccgcagcagcagcagcagcagcgccagggctaccgctcgtggcgcgggcacaagaacgccatagtcgcctgcttgcaagactgcgggggcaacatctctttcgcccgccgcttcctgctattccaccacggggtcgcctttccccgcaatgtcctgcattactaccgtcatctctacagcccctactgcagcggcgacccagaggcggcagcggcagccacagcggcgaccaccacctaggaagatatcctccgcgggcaagacagcggcagcagcggccaggagacccgcggcagcagcggcgggagcggtgggcgcactgcgcctctcgcccaacgaacccctctcgacccgggagctcagacacaggatcttccccactttgtatgccatcttccaacagagcagaggccaggagcaggagctgaaaataaaaaacagatctctgcgctccctcacccgcagctgtctgtatcacaaaagcgaagatcagcttcggcgcacgctggaggacgcggaggcactcttcagcaaatactgcgcgctcactcttaaagactagctccgcgcccttctcgaatttaggcgggagaaaactacgtcatcgccggccgccgcccagcccgcccagccgagatgagcaaagagattcccacgccatacatgtggagctaccagccgcagatgggactcgcggcgggagcggcccaggactactccacccgcatgaactacatgagcgcgggaccccacatgatctcacaggtcaacgggatccgcgcccagcgaaaccaaatactgctggaacaggcggccatcaccgccacgccccgccataatctcaacccccgaaattggcccgccgccctcgtgtaccaggaaaccccctccgccaccaccgtactacttccgcgtgacgcccaggccgaagtccagatgactaactcaggggcgcagctcgcgggcggctttcgtcacggggcgcggccgctccgaccaggtataagacacctgatgatcagaggccgaggtatccagctcaacgacgagtcggtgagctcttcgctcggtctccgtccggacggaactttccagctcgccggatccggccgctcttcgttcacgccccgccaggcgtacctgactctgcagacctcgtcctcggagccccgctccggcggcatcggaaccctccagttcgtggaggagttcgtgccctcggtctacttcaaccccttctcgggacctcccggacgctaccccgaccagttcattccgaactttgacgcggtgaaggactcggcggacggctacgactgaatgtcaggtgtcgaggcagagcagcttcgcctgagacacctcgagcactgccgccgccacaagtgcttcgcccgcggttctggtgagttctgctactttcagctacccgaggagcataccgaggggccggcgcacggcgtccgcctgaccacccagggcgaggttacctgttccctcatccgggagtttaccctccgtcccctgctagtggagcgggagcggggtccctgtgtcctaactatcgcctgcaactgccctaaccctggattacatcaagatctttgctgtcatctctgtgctgagtttaataaacgctgagatcagaatctactggggctcctgtcgccatcctgtgaacgccaccgtcttcacccaccccgaccaggcccaggcgaacctcacctgcggtctgcatcggagggccaagaagtacctcacctggtacttcaacggcaccccctttgtggtttacaacagcttcgacggggacggagtctccctgaaagaccagctctccggtctcagctactccatccacaagaacaccaccctccaactcttccctccctacctgccgggaacctacgagtgcgtcaccggccgctgcacccacctcacccgcctgatcgtaaaccagagctttccgggaacagataactccctcttccccagaacaggaggtgagctcaggaaactccccggggaccagggcggagacgtaccttcgacccttgtggggttaggattttttattaccgggttgctggctcttttaatcaaagtttccttgagatttgttctttccttctacgtgtatgaacacctcaacctccaataactctaccctttcttcggaatcaggtgacttctctgaaatcgggcttggtgtgctgcttactctgttgatttttttccttatcatactcagccttctgtgcctcaggctcgccgcctgctgcgcacacatctatatctactgctggttgctcaagtgcaggggtcgccacccaagatgaacaggtacatggtcctatcgatcctaggcctgctggccctggcggcctgcagcgccgccaaaaaagagattacctttgaggagcccgcttgcaatgtaactttcaagcccgagggtgaccaatgcaccaccctcgtcaaatgcgttaccaatcatgagaggctgcgcatcgactacaaaaacaaaactggccagtttgcggtctatagtgtgtttacgcccggagacccctctaactactctgtcaccgtcttccagggcggacagtctaagatattcaattacactttccctttttatgagttatgcgatgcggtcatgtacatgtcaaaacagtacaacctgtggcctccctctccccaggcgtgtgtggaaaatactgggtcttactgctgtatggctttcgcaatcactacgctcgctctaatctgcacggtgctatacataaaattcaggcagaggcgaatctttatcgatgaaaagaaaatgccttgatcgctaacaccggctttctatctgcagaatgaatgcaatcacctccctactaatcaccaccaccctccttgcgattgcccatgggttgacacgaatcgaagtgccagtggggtccaatgtcaccatggtgggccccgccggcaattccaccctcatgtgggaaaaatttgtccgcaatcaatgggttcatttctgctctaaccgaatcagtatcaagcccagagccatctgcgatgggcaaaatctaactctgatcaatgtgcaaatgatggatgctgggtactattacgggcagcggggagaaatcattaattactggcgaccccacaaggactacatgctgcatgtagtcgaggcacttcccactaccacccccactaccacctctcccaccaccaccaccactactactactactactactactactactactaccactaccgctgcccgccatacccgcaaaagcaccatgattagcacaaagccccctcgtgctcactcccacgccggcgggcccatcggtgcgacctcagaaaccaccgagctttgcttctgccaatgcactaacgccagcgctcatgaactgttcgacctggagaatgaggatgtccagcagagctccgcttgcctgacccaggaggctgtggagcccgttgccctgaagcagatcggtgattcaataattgactcttcttcttttgccactcccgaataccctcccgattctactttccacatcacgggtaccaaagaccctaacctctctttctacctgatgctgctgctctgtatctctgtggtctcttccgcgctgatgttactggggatgttctgctgcctgatctgccgcagaaagagaaaagctcgctctcagggccaaccactgatgcccttcccctaccccccggattttgcagataacaagatatgagctcgctgctgacactaaccgctttactagcctgcgctctaacccttgtcgcttgcgactcgagattccacaatgtcacagctgtggcaggagaaaatgttactttcaactccacggccgatacccagtggtcgtggagtggctcaggtagctacttaactatctgcaatagctccacttcccccggcatatccccaaccaagtaccaatgcaatgccagcctgttcaccctcatcaacgcttccaccctggacaatggactctatgtaggctatgtaccctttggtgggcaaggaaagacccacgcttacaacctggaagttcgccagcccagaaccactacccaagcttctcccaccaccaccaccaccaccaccatcaccagcagcagcagcagcagcagccacagcagcagcagcagattattgactttggttttggccagctcatctgccgctacccaggccatctacagctctgtgcccgaaaccactcagatccaccgcccagaaacgaccaccgccaccaccctacacacctccagcgatcagatgccgaccaacatcacccccttggctcttcaaatgggacttacaagccccactccaaaaccagtggatgcggccgaggtctccgccctcgtcaatgactgggcggggctgggaatgtggtggttcgccataggcatgatggcgctctgcctgcttctgctctggctcatctgctgcctccaccgcaggcgagccagaccccccatctatagacccatcattgtcctgaaccccgataatgatgggatccatagattggatggcctgaaaaacctacttttttcttttacagtatgataaattgagacatgcctcgcattttcttgtacatgttccttctcccaccttttctggggtgttctacgctggccgctgtgtctcacctggaggtagactgcctctcacccttcactgtctacctgctttacggattggtcaccctcactctcatctgcagcctaatcacagtaatcatcgccttcatccagtgcattgattacatctgtgtgcgcctcgcatacttcagacaccacccgcagtaccgagacaggaacattgcccaacttctaagactgctctaatcatgcataagactgtgatctgccttctgatcctctgcatcctgcccaccctcacctcctgccagtacaccacaaaatctccgcgcaaaagacatgcctcctgccgcttcacccaactgtggaatatacccaaatgctacaacgaaaagagcgagctctccgaagcttggctgtatggggtcatctgtgtcttagttttctgcagcactgtctttgccctcataatctacccctactttgatttgggatggaacgcgatcgatgccatgaattaccccacctttcccgcacccgagataattccactgcgacaagttgtacccgttgtcgttaatcaacgccccccatcccctacgcccactgaaatcagctactttaacctaacaggcggagatgactgacgccctagatctagaaatggacggcatcagtaccgagcagcgtctcctagagaggcgcaggcaggcggctgagcaagagcgcctcaatcaggagctccgagatctcgttaacctgcaccagtgcaaaagaggcatcttttgtctggtaaagcaggccaaagtcacctacgagaagaccggcaacagccaccgcctcagttacaaattgcccacccagcgccagaagctggtgctcatggtgggtgagaatcccatcaccgtcacccagcactcggtagagaccgaggggtgtctgcactccccctgtcggggtccagaagacctctgcaccctggtaaagaccctgtgcggtctcagagatttagtcccctttaactaatcaaacactggaatcaataaaaagaatcacttacttaaaatcagacagcaggtctctgtccagtttattcagcagcacctccttcccctcctcccaactctggtactccaaacgccttctggcggcaaacttcctccacaccctgaagggaatgtcagattcttgctcctgtccctccgcacccactatcttcatgttgttgcagatgaagcgcaccaaaacgtctgacgagagcttcaaccccgtgtacccctatgacacggaaagcggccctccctccgtccctttcctcacccctcccttcgtgtctcccgatggattccaagaaagtccccccggggtcctgtctctgaacctggccgagcccctggtcacttcccacggcatgctcgccctgaaaatgggaagtggcctctccctggacgacgctggcaacctcacctctcaagatatcaccaccgctagccctcccctcaaaaaaaccaagaccaacctcagcctagaaacctcatcccccctaactgtgagcacctcaggcgccctcaccgtagcagccgccgctcccctggcggtggccggcacctccctcaccatgcaatcagaggcccccctgacagtacaggatgcaaaactcaccctggccaccaaaggccccctgaccgtgtctgaaggcaaactggccttgcaaacatcggccccgctgacggccgctgacagcagcaccctcacagtcagtgccacaccaccccttagcacaagcaatggcagcttgggtattgacatgcaagcccccatttacaccaccaatggaaaactaggacttaactttggcgctcccctgcatgtggtagacagcctaaatgcactgactgtagttactggccaaggtcttacgataaacggaacagccctacaaactagagtctcaggtgccctcaactatgacacatcaggaaacctagaattgagagctgcagggggtatgcgagttgatgcaaatggtcaacttatccttgatgtagcttacccatttgatgcacaaaacaatctcagccttaggcttggacagggacccctgtttgttaactctgcccacaacttggatgttaactacaacagaggcctctacctgttcacatctggaaataccaaaaagctagaagttaatatcaaaacagccaagggtctcatttatgatgacactgctatagcaatcaatgcgggtgatgggctacagtttgactcaggctcagatacaaatccattaaaaactaaacttggattaggactggattatgactccagcagagccataattgctaaactgggaactggcctaagctttgacaacacaggtgccatcacagtaggcaacaaaaatgatgacaagcttaccttgtggaccacaccagacccatcccctaactgtagaatctattcagagaaagatgctaaattcacacttgttttgactaaatgcggcagtcaggtgttggccagcgtttctgttttatctgtaaaaggtagccttgcgcccatcagtggcacagtaactagtgctcagattgtcctcagatttgatgaaaatggagttctactaagcaattcttcccttgaccctcaatactggaactacagaaaaggtgaccttacagagggcactgcatataccaacgcagtgggatttatgcccaacctcacagcatacccaaaaacacagagccaaactgctaaaagcaacattgtaagtcaggtttacttgaatggggacaaatccaaacccatgaccctcaccattaccctcaatggaactaatgaaacaggagatgccacagtaagcacttactccatgtcattctcatggaactggaatggaagtaattacattaatgaaacgttccaaaccaactccttcaccttctcctacatcgcccaagaataaaaagcatgacgctgttgatttgattcaatgtgtttctgttttattttcaagcacaacaaaatcattcaagtcattcttccatcttagcttaatagacacagtagcttaatagacccagtagtgcaaagccccattctagcttataactagtggagaagtactcgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagtcttagatctctcaacgcagcaccagcaccaacacttcgcagtgtaaaaggccaagtgccgagagagtatatataggaataaaaagtgacgtaaacgggcaaagtccaaaaaacgcccagaaaaaccgcacgcgaacctacgccccgaaacgaaagccaaaaaacactagacactcccttccggcgtcaacttccgctttcccacgctacgtcacttgccccagtcaaacaaactacatatcccgaacttccaagtcgccacgcccaaaacaccgcctacacctccccgcccgccggcccgcccccaaacccgcctcccgccccgcgccccgccccgcgccgcccatctcattatcatattggcttcaatccaaaataaggtatattattgatgatggtttaaacggatccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcagatccgaattcgtttaaac

SEQ ID NO: 8 - DNA, 43428 bp, Artificial
  synthetic polynucleotide
catcatcaataatataccttattttggattgaagccaatatgataatgagatgggcggcgcggggcggggcgcggggcgggaggcgggtttgggggcgggccggcgggcggggcggtgtggcggaagtggactttgtaagtgtggcggatgtgacttgctagtgccgggcgcggtaaaagtgacgttttccgtgcgcgacaacgcccccgggaagtgacatttttcccgcggtttttaccggatgttgtagtgaatttgggcgtaaccaagtaagatttggccattttcgcgggaaaactgaaacggggaagtgaaatctgattaattttgcgttagtcataccgcgtaatatttgtctagggccgagggactttggccgattacgtggaggactcgcccaggtgttttttgaggtgaatttccgcgttccgggtcaaagtctgcgttttattattataggatatcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccgcggccgggaacggtgcattggaacgcggattccccgtgccaagagtgagatcttccgtttatctaggtaccgggccccccctcgaggtcgacggtatcgataagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctaaccaggagctatttaatggcaacagttaaccagctggtacgcaaaccacgtgctcgcaaagttgcgaaaagcaacgtgcctgcgctggaagcatgcccgcaaaaacgtggcgtatgtactcgtgtatatactaccactcctaaaaaaccgaactccgcgctgcgtaaagtatgccgtgttcgtctgactaacggtttcgaagtgacttcctacatcggtggtgaaggtcacaacctgcaggagcactccgtgatcctgatccgtggcggtcgtgttaaagacctcccgggtgttcgttaccacaccgtacgtggtgcgcttgactgctccggcgttaaagaccgtaagcaggctcgttccaagtatggcgtgaagcgtcctaaggcttaatggtagatctgatcaagagacaggatgacggtcgtttcgcatgcttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccgggctcgatcccctcggggggaatcagaattcagtcgacagcggccgcgatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggccgatcagcgatcgctgaggtgggtgagtgggcgtggcctggggtggtcatgaaaatatataagttgggggtcttagggtctctttatttgtgttgcagagaccgccggagccatgagcgggagcagcagcagcagcagtagcagcagcgccttggatggcagcatcgtgagcccttatttgacgacgcggatgccccactgggccggggtgcgtcagaatgtgatgggctccagcatcgacggccgacccgtcctgcccgcaaattccgccacgctgacctatgcgaccgtcgcggggacgccgttggacgccaccgccgccgccgccgccaccgcagccgcctcggccgtgcgcagcctggccacggactttgcattcctgggaccactggcgacaggggctacttctcgggccgctgctgccgccgttcgcgatgacaagctgaccgccctgctggcgcagttggatgcgcttactcgggaactgggtgacctttctcagcaggtcatggccctgcgccagcaggtctcctccctgcaagctggcgggaatgcttctcccacaaatgccgtttaagataaataaaaccagactctgtttggattaaagaaaagtagcaagtgcattgctctctttatttcataattttccgcgcgcgataggccctagaccagcgttctcggtcgttgagggtgcggtgtatcttctccaggacgtggtagaggtggctctggacgttgagatacatgggcatgagcccgtcccgggggtggaggtagcaccactgcagagcttcatgctccggggtggtgttgtagatgatccagtcgtagcaggagcgctgggcatggtgcctaaaaatgtccttcagcagcaggccgatggccagggggaggcccttggtgtaagtgtttacaaaacggttaagttgggaagggtgcattcggggagagatgatgtgcatcttggactgtatttttagattggcgatgtttccgcccagatcccttctgggattcatgttgtgcaggaccaccagtacagtgtatccggtgcacttggggaatttgtcatgcagcttagagggaaaagcgtggaagaacttggagacgcctttgtggcctcccagattttccatgcattcgtccatgatgatggcaatgggcccgcgggaggcagcttgggcaaagatatttctggggtcgctgacgtcgtagttgtgttccagggtgaggtcgtcataggccatttttacaaagcgcgggcggagggtgcccgactgggggatgatggtcccctctggccctggggcgtagttgccctcgcagatctgcatttcccaggccttaatctcggaggggggaatcatatccacctgcggggcgatgaagaaaacggtttccggagccggggagattaactgggatgagagcaggtttctaagcagctgtgattttccacaaccggtgggcccataaataacacctataaccggttgcagctggtagtttagagagctgcagctgccgtcgtcccggaggaggggggccacctcgttgagcatgtccctgacgcgcatgttctccccgaccagatccgccagaaggcgctcgccgcccagggacagcagctcttgcaaggaagcaaagtttttcagcggcttgaggccgtccgccgtgggcatgtttttcagggtctggctcagcagctccaggcggtcccagagctcggtgacgtgctctacggcatctctatccagcatatctcctcgtttcgcgggttggggcgactttcgctgtagggcaccaagcggtggtcgtccagcggggccagagtcatgtccttccatgggcgcagggtcctcgtcagggtggtctgggtcacggtgaaggggtgcgctccgggctgagcgcttgccaaggtgcgcttgaggctggttctgctggtgctgaagcgctgccggtcttcgccctgcgcgtcggccaggtagcatttgaccatggtgtcatagtccagcccctccgcggcgtgtcccttggcgcgcagcttgcccttggaggtggcgccgcacgaggggcagagcaggctcttgagcgcgtagagcttgggggcgaggaagaccgattcgggggagtaggcgtccgcgccgcagaccccgcacacggtctcgcactccaccagccaggtgagctcggggcgcgccgggtcaaaaaccaggtttcccccatgctttttgatgcgtttcttacctcgggtctccatgaggtggtgtccccgctcggtgacgaagaggctgtccgtgtctccgtagaccgacttgaggggtcttttctccaggggggtccctcggtcttcctcgtagaggaactcggaccactctgagacgaaggcccgcgtccaggccaggacgaaggaggctatgtgggaggggtagcggtcgttgtccactagggggtccaccttctccaaggtgtgaagacacatgtcgccttcctcggcgtccaggaaggtgattggcttgtaggtgtaggccacgtgaccgggggttcctgacgggggggtataaaagggggtgggggcgcgctcgtcgtcactctcttccgcatcgctgtctgcgagggccagctgctggggtgagtattccctctcgaaggcgggcatgacctccgcgctgaggttgtcagtttccaaaaacgaggaggatttgatgttcacctgtcccgaggtgatacctttgagggtacccgcgtccatctggtcagaaaacacgatctttttattgtccagcttggtggcgaacgacccgtagagggcgttggagagcagcttggcgatggagcgcagggtctggttcttgtccctgtcggcgcgctccttggccgcgatgttgagctgcacgtactcgcgcgcgacgcagcgccactcggggaagacggtggtgcgctcgtcgggcaccaggcgcacgcgccagccgcggttgtgcagggtgaccaggtccacgctggtggcgacctcgccgcgcaggcgctcgttggtccagcagagacggccgcccttgcgcgagcagaaggggggcagggggtcgagctgggtctcgtccggggggtccgcgtccacggtgaaaaccccggggcgcaggcgcgcgtcgaagtagtctatcttgcaaccttgcatgtccagcgcctgctgccagtcgcgggcggcgagcgcgcgctcgtaggggttgagcggcgggccccagggcatggggtgggtgagtgcggaggcgtacatgccgcagatgtcatagacgtagaggggctcccgcaggaccccgatgtaggtggggtagcagcggccgccgcggatgctggcgcgcacgtagtcatacagctcgtgcgagggggcgaggaggtcggggcccaggttggtgcgggcggggcgctccgcgcggaagacgatctgcctgaagatggcatgcgagttggaagagatggtggggcgctggaagacgttgaagctggcgtcctgcaggccgacggcgtcgcgcacgaaggaggcgtaggagtcgcgcagcttgtgtaccagctcggcggtgacctgcacgtcgagcgcgcagtagtcgagggtctcgcggatgatgtcatatttagcctgccccttctttttccacagctcgcggttgaggacaaactcttcgcggtctttccagtactcttggatcgggaaaccgtccggttccgaacggtaagagcctagcatgtagaactggttgacggcctggtaggcgcagcagcccttctccacggggagggcgtaggcctgcgcggccttgcggagcgaggtgtgggtcagggcgaaggtgtccctgaccatgactttgaggtactggtgcttgaagtcggagtcgtcgcagccgccccgctcccagagcgagaagtcggtgcgcttcttggagcgggggttgggcagagcgaaggtgacatcgttgaagaggattttgcccgcgcggggcatgaagttgcgggtgatgcggaagggccccggcacttcagagcggttgttgatgacctgggcggcgagcacgatctcgtcgaagccgttgatgttgtggcccacgatgtagagttccaggaagcggggccggccctttacggtgggcagcttctttagctcttcgtaggtgagctcctcgggcgaggcgaggccgtgctcggccagggcccagtccgcgaggtgcgggttgtctctgaggaaggacttccagaggtcgcgggccaggagggtctgcaggcggtctctgaaggtcctgaactggcggcccacggccattttttcgggggtgatgcagtagaaggtgagggggtcttgctgccagcggtcccagtcgagctgcagggcgaggtcgcgcgcggcggtgaccaggcgctcgtcgcccccgaatttcatgaccagcatgaagggcacgagctgctttccgaaggcccccatccaagtgtaggtctctacatcgtaggtgacaaagaggcgctccgtgcgaggatgcgagccgatcgggaagaactggatctcccgccaccagttggaggagtggctgttgatgtggtggaagtagaagtcccgtcgccgggccgaacactcgtgctggcttttgtaaaagcgagcgcagtactggcagcgctgcacgggctgtacctcatgcacgagatgcacctttcgcccgcgcacgaggaagccgaggggaaatctgagccccccgcctggctcgcggcatggctggttctcttctactttggatgcgtgtccgtctccgtctggctcctcgaggggtgttacggtggagcggaccaccacgccgcgcgagccgcaggtccagatatcggcgcgcggcggtcggagtttgatgacgacatcgcgcagctgggagctgtccatggtctggagctcccgcggcggcggcaggtcagccgggagttcttgcaggttcacctcgcagagtcgggccagggcgcggggcaggtctaggtggtacctgatctctaggggcgtgttggtggcggcgtcgatggcttgcaggagcccgcagccccggggggcgacgacggtgccccgcggggtggtggtggtggtggcggtgcagctcagaagcggtgccgcgggcgggcccccggaggtagggggggctccggtcccgcgggcaggggcggcagcggcacgtcggcgtggagcgcgggcaggagttggtgctgtgcccggaggttgctggcgaaggcgacgacgcggcggttgatctcctggatctggcgcctctgcgtgaagacgacgggcccggtgagcttgaacctgaaagagagttcgacagaatcaatctcggtgtcattgaccgcggcctggcgcaggatctcctgcacgtctcccgagttgtcttggtaggcgatctcggccatgaactgctcgatctcttcctcctggaggtctccgcgtccggcgcgttccacggtggccgccaggtcgttggagatgcgccccatgagctgcgagaaggcgttgagtccgccctcgttccagactcggctgtagaccacgcccccctggtcatcgcgggcgcgcatgaccacctgcgcgaggttgagctccacgtgccgcgcgaagacggcgtagttgcgcagacgctggaagaggtagttgagggtggtggcggtgtgctcggccacgaagaagttcatgacccagcggcgcaacgtggattcgttgatgtcccccaaggcctccagccgttccatggcctcgtagaagtccacggcgaagttgaaaaactgggagttgcgcgccgacacggtcaactcctcctccagaagacggatgagctcggcgacggtgtcgcgcacctcgcgctcgaaggctatggggatctcttcctccgctagcatcaccacctcctcctcttcctcctcttctggcacttccatgatggcttcctcctcttcggggggtggcggcggcggcggtgggggagggggcgctctgcgccggcggcggcgcaccgggaggcggtccacgaagcgcgcgatcatctccccgcggcggcggcgcatggtctcggtgacggcgcggccgttctcccgggggcgcagttggaagacgccgccggacatctggtgctggggcgggtggccgtgaggcagcgagacggcgctgacgatgcatctcaacaattgctgcgtaggtacgccgccgagggacctgagggagtccatatccaccggatccgaaaacctttcgaggaaggcgtctaaccagtcgcagtcgcaaggtaggctgagcaccgtggcgggcggcggggggtggggggagtgtctggcggaggtgctgctgatgatgtaattgaagtaggcggacttgacacggcggatggtcgacaggagcaccatgtccttgggtccggcctgctggatgcggaggcggtcggctatgccccaggcttcgttctggcatcggcgcaggtccttgtagtagtcttgcatgagcctttccaccggcacctcttctccttcctcttctgcttcttccatgtctgcttcggccctggggcggcgccgcgcccccctgccccccatgcgcgtgaccccgaaccccctgagcggttggagcagggccaggtcggcgacgacgcgctcggccaggatggcctgctgcacctgcgtgagggtggtttggaagtcatccaagtccacgaagcggtggtaggcgcccgtgttgatggtgtaggtgcagttggccatgacggaccagttgacggtctggtggcccggttgcgacatctcggtgtacctgagtcgcgagtaggcgcgggagtcgaagacgtagtcgttgcaagtccgcaccaggtactggtagcccaccaggaagtgcggcggcggctggcggtagaggggccagcgcagggtggcgggggctccgggggccaggtcttccagcatgaggcggtggtaggcgtagatgtacctggacatccaggtgatacccgcggcggtggtggaggcgcgcgggaagtcgcgcacccggttccagatgttgcgcaggggcagaaagtgctccatggtaggcgtgctctgtccagtcagacgcgcgcagtcgttgatactctagaccagggaaaacgaaagccggtcagcgggcactcttccgtggtctggtgaatagatcgcaagggtatcatggcggagggcctcggttcgagccccgggtccgggccggacggtccgccatgatccacgcggttaccgcccgcgtgtcgaacccaggtgtgcgacgtcagacaacggtggagtgttccttttggcgtttttctggccgggcgccggcgccgcgtaagagactaagccgcgaaagcgaaagcagtaagtggctcgctccccgtagccggagggatccttgctaagggttgcgttgcggcgaaccccggttcgaatcccgtactcgggccggccggacccgcggctaaggtgttggattggcctccccctcgtataaagaccccgcttgcggattgactccggacacggggacgagccccttttatttttgctttccccagatgcatccggtgctgcggcagatgcgccccccgccccagcagcagcaacaacaccagcaagagcggcagcaacagcagcgggagtcatgcagggccccctcacccaccctcggcgggccggccacctcggcgtccgcggccgtgtctggcgcctgcggcggcggcggggggccggctgacgaccccgaggagcccccgcggcgcagggccagacactacctggacctggaggagggcgagggcctggcgcggctgggggcgccgtctcccgagcgccacccgcgggtgcagctgaagcgcgactcgcgcgaggcgtacgtgcctcggcagaacctgttcagggaccgcgcgggcgaggagcccgaggagatgcgggacaggaggttcagcgcagggcgggagctgcggcaggggctgaaccgcgagcggctgctgcgcgaggaggactttgagcccgacgcgcggacggggatcagccccgcgcgcgcgcacgtggcggccgccgacctggtgacggcgtacgagcagacggtgaaccaggagatcaacttccaaaagagtttcaacaaccacgtgcgcacgctggtggcgcgcgaggaggtgaccatcgggctgatgcacctgtgggactttgtaagcgcgctggtgcagaaccccaacagcaagcctctgacggcgcagctgttcctgatagtgcagcacagcagggacaacgaggcgtttagggacgcgctgctgaacatcaccgagcccgagggtcggtggctgctggacctgattaacatcctgcagagcatagtggtgcaggagcgcagcctgagcctggccgacaaggtggcggccatcaactactcgatgctgagcctgggcaagttttacgcgcgcaagatctaccagacgccgtacgtgcccatagacaaggaggtgaagatcgacggtttttacatgcgcatggcgctgaaggtgctcaccctgagcgacgacctgggcgtgtaccgcaacgagcgcatccacaaggccgtgagcgtgagccggcggcgcgagctgagcgaccgcgagctgatgcacagcctgcagcgggcgctggcgggcgccggcagcggcgacagggaggcggagtcctacttcgatgcgggggcggacctgcgctgggcgcccagccggcgggccctggaggccgcgggggtccgcgaggactatgacgaggacggcgaggaggatgaggagtacgagctagaggagggcgagtacctggactaaaccgcgggtggtgtttccggtagatgcaagacccgaacgtggtggacccggcgctgcgggcggctctgcagagccagccgtccggccttaactcctcagacgactggcgacaggtcatggaccgcatcatgtcgctgacggcgcgtaacccggacgcgttccggcagcagccgcaggccaacaggctctccgccatcctggaggcggtggtgcctgcgcgctcgaaccccacgcacgagaaggtgctggccatagtgaacgcgctggccgagaacagggccatccgcccggacgaggccgggctggtgtacgacgcgctgctgcagcgcgtggcccgctacaacagcggcaacgtgcagaccaacctggaccggctggtgggggacgtgcgcgaggcggtggcgcagcgcgagcgcgcggatcggcagggcaacctgggctccatggtggcgctgaatgccttcctgagcacgcagccggccaacgtgccgcgggggcaggaagactacaccaactttgtgagcgcgctgcggctgatggtgaccgagaccccccagagcgaggtgtaccagtcgggcccggactacttcttccagaccagcagacagggcctgcagacggtgaacctgagccaggctttcaagaacctgcgggggctgtggggcgtgaaggcgcccaccggcgaccgggcgacggtgtccagcctgctgacgcccaactcgcgcctgctgctgctgctgatcgcgccgttcacggacagcggcagcgtgtcccgggacacctacctggggcacctgctgaccctgtaccgcgaggccatcgggcaggcgcaggtggacgagcacaccttccaggagatcaccagcgtgagccgcgcgctggggcaggaggacacgagcagcctggaggcgactctgaactacctgctgaccaaccggcggcagaagattccctcgctgcacagcctgacctccgaggaggagcgcatcttgcgctacgtgcagcagagcgtgagcctgaacctgatgcgcgacggggtgacgcccagcgtggcgctggacatgaccgcgcgcaacatggaaccgggcatgtacgccgcgcaccggccttacatcaaccgcctgatggactacctgcatcgcgcggcggccgtgaaccccgagtactttaccaacgccatcctgaacccgcactggctcccgccgcccgggttctacagcgggggcttcgaggtcccggagaccaacgatggcttcctgtgggacgacatggacgacagcgtgttctccccgcggccgcaggcgctggcggaagcgtccctgctgcgtcccaagaaggaggaggaggaggaggcgagtcgccgccgcggcagcagcggcgtggcttctctgtccgagctgggggcggcagccgccgcgcgccccgggtccctgggcggcagcccctttccgagcctggtggggtctctgcacagcgagcgcaccacccgccctcggctgctgggcgaggacgagtacctgaataactccctgctgcagccggtgcgggagaaaaacctgcctcccgccttccccaacaacgggatagagagcctggtggacaagatgagcagatggaagacctatgcgcaggagcacagggacgcgcctgcgctccggccgcccacgcggcgccagcgccacgaccggcagcgggggctggtgtgggatgacgaggactccgcggacgatagcagcgtgctggacctgggagggagcggcaacccgttcgcgcacctgcgcccccgcctggggaggatgttttaaaaaaaaaaaaaaaaagcaagaagcatgatgcaaaaattaaataaaactcaccaaggccatggcgaccgagcgttggtttcttgtgttcccttcagtatgcggcgcgcggcgatgtaccaggagggacctcctccctcttacgagagcgtggtgggcgcggcggcggcggcgccctcttctccctttgcgtcgcagctgctggagccgccgtacgtgcctccgcgctacctgcggcctacgggggggagaaacagcatccgttactcggagctggcgcccctgttcgacaccacccgggtgtacctggtggacaacaagtcggcggacgtggcctccctgaactaccagaacgaccacagcaattttttgaccacggtcatccagaacaatgactacagcccgagcgaggccagcacccagaccatcaatctggatgaccggtcgcactggggcggcgacctgaaaaccatcctgcacaccaacatgcccaacgtgaacgagttcatgttcaccaataagttcaaggcgcgggtgatggtgtcgcgctcgcacaccaaggaagaccgggtggagctgaagtacgagtgggtggagttcgagctgccagagggcaactactccgagaccatgaccattgacctgatgaacaacgcgatcgtggagcactatctgaaagtgggcaggcagaacggggtcctggagagcgacatcggggtcaagttcgacaccaggaacttccgcctggggctggaccccgtgaccgggctggttatgcccggggtgtacaccaacgaggccttccatcccgacatcatcctgctgcccggctgcggggtggacttcacttacagccgcctgagcaacctcctgggcatccgcaagcggcagcccttccaggagggcttcaggatcacctacgaggacctggaggggggcaacatccccgcgctcctcgatgtggaggcctaccaggatagcttgaaggaaaatgaggcgggacaggaggataccgcccccgccgcctccgccgccgccgagcagggcgaggatgctgctgacaccgcggccgcggacggggcagaggccgaccccgctatggtggtggaggctcccgagcaggaggaggacatgaatgacagtgcggtgcgcggagacaccttcgtcacccggggggaggaaaagcaagcggaggccgaggccgcggccgaggaaaagcaactggcggcagcagcggcggcggcggcgttggccgcggcggaggctgagtctgaggggaccaagcccgccaaggagcccgtgattaagcccctgaccgaagatagcaagaagcgcagttacaacctgctcaaggacagcaccaacaccgcgtaccgcagctggtacctggcctacaactacggcgacccgtcgacgggggtgcgctcctggaccctgctgtgcacgccggacgtgacctgcggctcggagcaggtgtactggtcgctgcccgacatgatgcaagaccccgtgaccttccgctccacgcggcaggtcagcaacttcccggtggtgggcgccgagctgctgcccgtgcactccaagagcttctacaacgaccaggccgtctactcccagctcatccgccagttcacctctctgacccacgtgttcaatcgctttcctgagaaccagattctggcgcgcccgcccgcccccaccatcaccaccgtcagtgaaaacgttcctgctctcacagatcacgggacgctaccgctgcgcaacagcatcggaggagtccagcgagtgaccgttactgacgccagacgccgcacctgcccctacgtttacaaggccttgggcatagtctcgccgcgcgtcctttccagccgcactttttgagcaacaccaccatcatgtccatcctgatctcacccagcaataactccggctggggactgctgcgcgcgcccagcaagatgttcggaggggcgaggaagcgttccgagcagcaccccgtgcgcgtgcgcgggcacttccgcgccccctggggagcgcacaaacgcggccgcgcggggcgcaccaccgtggacgacgccatcgactcggtggtggagcaggcgcgcaactacaggcccgcggtctctaccgtggacgcggccatccagaccgtggtgcggggcgcgcggcggtacgccaagctgaagagccgccggaagcgcgtggcccgccgccaccgccgccgacccggggccgccgccaaacgcgccgccgcggccctgcttcgccgggccaagcgcacgggccgccgcgccgccatgagggccgcgcgccgcttggccgccggcatcaccgccgccaccatggccccccgtacccgaagacgcgcggccgccgccgccgccgccgccatcagtgacatggccagcaggcgccggggcaacgtgtactgggtgcgcgactcggtgaccggcacgcgcgtgcccgtgcgcttccgccccccgcggacttgagatgatgtgaaaaaacaacactgagtctcctgctgttgtgtgtatcccagcggcggcggcgcgcgcagcgtcatgtccaagcgcaaaatcaaagaagagatgctccaggtcgtcgcgccggagatctatgggcccccgaagaaggaagagcaggattcgaagccccgcaagataaagcgggtcaaaaagaaaaagaaagatgatgacgatgccgatggggaggtggagttcctgcgcgccacggcgcccaggcgcccggtgcagtggaagggccggcgcgtaaagcgcgtcctgcgccccggcaccgcggtggtcttcacgcccggcgagcgctccacccggactttcaagcgcgtctatgacgaggtgtacggcgacgaagacctgctggagcaggccaacgagcgcttcggagagtttgcttacgggaagcgtcagcgggcgctggggaaggaggacctgctggcgctgccgctggaccagggcaaccccacccccagtctgaagcccgtgaccctgcagcaggtgctgccgagcagcgcaccctccgaggcgaagcggggtctgaagcgcgagggcggcgacctggcgcccaccgtgcagctcatggtgcccaagcggcagaggctggaggatgtgctggagaaaatgaaagtagaccccggtctgcagccggacatcagggtccgccccatcaagcaggtggcgccgggcctcggcgtgcagaccgtggacgtggtcatccccaccggcaactcccccgccgccgccaccactaccgctgcctccacggacatggagacacagaccgatcccgccgcagccgcagccgcagccgccgccgcgacctcctcggcggaggtgcagacggacccctggctgccgccggcgatgtcagctccccgcgcgcgtcgcgggcgcaggaagtacggcgccgccaacgcgctcctgcccgagtacgccttgcatccttccatcgcgcccacccccggctaccgaggctatacctaccgcccgcgaagagccaagggttccacccgccgtccccgccgacgcgccgccgccaccacccgccgccgccgccgcagacgccagcccgcactggctccagtctccgtgaggaaagtggcgcgcgacggacacaccctggtgctgcccagggcgcgctaccaccccagcatcgtttaaaagcctgttgtggttcttgcagatatggccctcacttgccgcctccgtttcccggtgccgggataccgaggaggaagatcgcgccgcaggaggggtctggccggccgcggcctgagcggaggcagccgccgcgcgcaccggcggcgacgcgccaccagccgacgcatgcgcggcggggtgctgcccctgttaatccccctgatcgccgcggcgatcggcgccgtgcccgggatcgcctccgtggccttgcaagcgtcccagaggcattgacagacttgcaaacttgcaaatatggaaaaaaaaaccccaataaaaaagtctagactctcacgctcgcttggtcctgtgactattttgtagaatggaagacatcaactttgcgtcgctggccccgcgtcacggctcgcgcccgttcctgggacactggaacgatatcggcaccagcaacatgagcggtggcgccttcagttggggctctctgtggagcggcattaaaagtatcgggtctgccgttaaaaattacggctcccgggcctggaacagcagcacgggccagatgttgagagacaagttgaaagagcagaacttccagcagaaggtggtggagggcctggcctccggcatcaacggggtggtggacctggccaaccaggccgtgcagaataagatcaacagcagactggacccccggccgccggtggaggaggtgccgccggcgctggagacggtgtcccccgatgggcgtggcgagaagcgcccgcggcccgatagggaagagaccactctggtcacgcagaccgatgagccgcccccgtatgaggaggccctgaagcaaggtctgcccaccacgcggcccatcgcgcccatggccaccggggtggtgggccgccacacccccgccacgctggacttgcctccgcccgccgatgtgccgcagcagcagaaggcggcacagccgggcccgcccgcgaccgcctcccgttcctccgccggtcctctgcgccgcgcggccagcggcccccgcgggggggtcgcgaggcacggcaactggcagagcacgctgaacagcatcgtgggtctgggggtgcggtccgtgaagcgccgccgatgctactgaatagcttagctaacgtgttgtatgtgtgtatgcgccctatgtcgccgccagaggagctgctgagtcgccgccgttcgcgcgcccaccaccaccgccactccgcccctcaagatggcgaccccatcgatgatgccgcagtggtcgtacatgcacatctcgggccaggacgcctcggagtacctgagccccgggctggtgcagttcgcccgcgccaccgagagctacttcagcctgagtaacaagtttaggaaccccacggtggcgcccacgcacgatgtgaccaccgaccggtctcagcgcctgacgctgcggttcattcccgtggaccgcgaggacaccgcgtactcgtacaaggcgcggttcaccctggccgtgggcgacaaccgcgtgctggacatggcctccacctactttgacatccgcggggtgctggaccggggtcccactttcaagccctactctggcaccgcctacaactccctggcccccaagggcgctcccaactcctgcgagtgggagcaagaggaaactcaggcagttgaagaagcagcagaagaggaagaagaagatgctgacggtcaagctgaggaagagcaagcagctaccaaaaagactcatgtatatgctcaggctcccctttctggcgaaaaaattagtaaagatggtctgcaaataggaacggacgctacagctacagaacaaaaacctatttatgcagaccctacattccagcccgaaccccaaatcggggagtcccagtggaatgaggcagatgctacagtcgccggcggtagagtgctaaagaaatctactcccatgaaaccatgctatggttcctatgcaagacccacaaatgctaatggaggtcagggtgtactaacggcaaatgcccagggacagctagaatctcaggttgaaatgcaattcttttcaacttctgaaaacgcccgtaacgaggctaacaacattcagcccaaattggtgctgtatagtgaggatgtgcacatggagaccccggatacgcacctttcttacaagcccgcaaaaagcgatgacaattcaaaaatcatgctgggtcagcagtccatgcccaacagacctaattacatcggcttcagagacaactttatcggcctcatgtattacaatagcactggcaacatgggagtgcttgcaggtcaggcctctcagttgaatgcagtggtggacttgcaagacagaaacacagaactgtcctaccagctcttgcttgattccatgggtgacagaaccagatacttttccatgtggaatcaggcagtggacagttatgacccagatgttagaattattgaaaatcatggaactgaagacgagctccccaactattgtttccctctgggtggcataggggtaactgacacttaccaggctgttaaaaccaacaatggcaataacgggggccaggtgacttggacaaaagatgaaacttttgcagatcgcaatgaaataggggtgggaaacaatttcgctatggagatcaacctcagtgccaacctgtggagaaacttcctgtactccaacgtggcgctgtacctaccagacaagcttaagtacaacccctccaatgtggacatctctgacaaccccaacacctacgattacatgaacaagcgagtggtggccccggggctggtggactgctacatcaacctgggcgcgcgctggtcgctggactacatggacaacgtcaaccccttcaaccaccaccgcaatgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggtaacgatctcagggtggacggggccagcatcaagttcgagagcatctgcctctacgccaccttcttccccatggcccacaacacggcctccacgctcgaggccatgctcaggaacgacaccaacgaccagtccttcaatgactacctctccgccgccaacatgctctaccccatacccgccaacgccaccaacgtccccatctccatcccctcgcgcaactgggcggccttccgcggctgggccttcacccgcctcaagaccaaggagaccccctccctgggctcgggattcgacccctactacacctactcgggctccattccctacctggacggcaccttctacctcaaccacactttcaagaaggtctcggtcaccttcgactcctcggtcagctggccgggcaacgaccgtctgctcacccccaacgagttcgagatcaagcgctcggtcgacggggagggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctatccgctcataggcaagaccgcggtcgacagcatcacccagaaaaagttcctctgcgaccgcaccctctggcgcatccccttctccagcaacttcatgtccatgggtgcgctctcggacctgggccagaacttgctctacgccaactccgcccacgccctcgacatgaccttcgaggtcgaccccatggacgagcccacccttctctatgttctgttcgaagtctttgacgtggtccgggtccaccagccgcaccgcggcgtcatcgagaccgtgtacctgcgtacgcccttctcggccggcaacgccaccacctaaagaagcaagccgcagtcatcgccgcctgcatgccgtcgggttccaccgagcaagagctcagggccatcgtcagagacctgggatgcgggccctattttttgggcaccttcgacaagcgcttccctggctttgtctccccacacaagctggcctgcgccatcgtcaacacggccggccgcgagaccgggggcgtgcactggctggccttcgcctggaacccgcgctccaaaacatgcttcctctttgaccccttcggcttttcggaccagcggctcaagcaaatctacgagttcgagtacgagggcttgctgcgtcgcagcgccatcgcctcctcgcccgaccgctgcgtcaccctcgaaaagtccacccagaccgtgcaggggcccgactcggccgcctgcggtctcttctgctgcatgtttctgcacgcctttgtgcactggcctcagagtcccatggaccgcaaccccaccatgaacttgctgacgggggtgcccaactccatgctccagagcccccaggtcgagcccaccctgcgccgcaaccaggagcagctctacagcttcctggagcgccactcgccttacttccgccgccacagcgcacagatcaggagggccacctccttctgccacttgcaagagatgcaagaagggtaataacgatgtacacactttttttctcaataaatggcatctttttatttatacaagctctctggggtattcatttcccaccaccacccgccgttgtcgccatctggctctatttagaaatcgaaagggttctgccgggagtcgccgtgcgccacgggcagggacacgttgcgatactggtagcgggtgccccacttgaactcgggcaccaccaggcgaggcagctcggggaagttttcgctccacaggctgcgggtcagcaccagcgcgttcatcaggtcgggcgccgagatcttgaagtcgcagttggggccgccgccctgcgcgcgcgagttgcggtacaccgggttgcagcactggaacaccaacagcgccgggtgcttcacgctggccagcacgctgcggtcggagatcagctcggcgtccaggtcctccgcgttgctcagcgcgaacggggtcatcttgggcacttgccgccccaggaagggcgcgtgccccggtttcgagttgcagtcgcagcgcagcgggatcagcaggtgcccgtgcccggactcggcgttggggtacagcgcgcgcatgaaggcctgcatctggcggaaggccatctgggccttggcgccctccgagaagaacatgccgcaggacttgcccgagaactggtttgcggggcagctggcgtcgtgcaggcagcagcgcgcgtcggtgttggcgatctgcaccacgttgcgcccccaccggttcttcacgatcttggccttggacgattgctccttcagcgcgcgctgcccgttctcgctggtcacatccatctcgatcacatgttccttgttcaccatgctgctgccgtgcagacacttcagctcgccctccgtctcggtgcagcggtgctgccacagcgcgcagcccgtgggctcgaaagacttgtaggtcacctccgcgaaggactgcaggtacccctgcaaaaagcggcccatcatggtcacgaaggtcttgttgctgctgaaggtcagctgcagcccgcggtgctcctcgttcagccaggtcttgcacacggccgccagcgcctccacctggtcgggcagcatcttgaagttcaccttcagctcattctccacgtggtacttgtccatcagcgtgcgcgccgcctccatgcccttctcccaggccgacaccagcggcaggctcacggggttcttcaccatcaccgtggccgccgcctccgccgcgctttcgctttccgccccgctgttctcttcctcttcctcctcttcctcgccgccgcccactcgcagcccccgcaccacggggtcgtcttcctgcaggcgctgcaccttgcgcttgccgttgcgcccctgcttgatgcgcacgggcgggttgctgaagcccaccatcaccagcgcggcctcttcttgctcgtcctcgctgtccagaatgacctccggggagggggggttggtcatcctcagtaccgaggcacgcttctttttcttcctgggggcgttcgccagctccgcggctgcggccgctgccgaggtcgaaggccgagggctgggcgtgcgcggcaccagcgcgtcctgcgagccgtcctcgtcctcctcggactcgagacggaggcgggcccgcttcttcgggggcgcgcggggcggcggaggcggcggcggcgacggagacggggacgagacatcgtccagggtgggtggacggcgggccgcgccgcgtccgcgctcgggggtggtctcgcgctggtcctcttcccgactggccatctcccactgctccttctcctataggcagaaagagatcatggagtctctcatgcgagtcgagaaggaggaggacagcctaaccgccccctctgagccctccaccaccgccgccaccaccgccaatgccgccgcggacgacgcgcccaccgagaccaccgccagtaccaccctccccagcgacgcacccccgctcgagaatgaagtgctgatcgagcaggacccgggttttgtgagcggagaggaggatgaggtggatgagaaggagaaggaggaggtcgccgcctcagtgccaaaagaggataaaaagcaagaccaggacgacgcagataaggatgagacagcagtcgggcgggggaacggaagccatgatgctgatgacggctacctagacgtgggagacgacgtgctgcttaagcacctgcaccgccagtgcgtcatcgtctgcgacgcgctgcaggagcgctgcgaagtgcccctggacgtggcggaggtcagccgcgcctacgagcggcacctcttcgcgccgcacgtgccccccaagcgccgggagaacggcacctgcgagcccaacccgcgtctcaacttctacccggtcttcgcggtacccgaggtgctggccacctaccacatctttttccaaaactgcaagatccccctctcctgccgcgccaaccgcacccgcgccgacaaaaccctgaccctgcggcagggcgcccacatacctgatatcgcctctctggaggaagtgcccaagatcttcgagggtctcggtcgcgacgagaaacgggcggcgaacgctctgcacggagacagcgaaaacgagagtcactcgggggtgctggtggagctcgagggcgacaacgcgcgcctggccgtactcaagcgcagcatagaggtcacccactttgcctacccggcgctcaacctgccccccaaggtcatgagtgtggtcatgggcgagctcatcatgcgccgcgcccagcccctggccgcggatgcaaacttgcaagagtcctccgaggaaggcctgcccgcggtcagcgacgagcagctggcgcgctggctggagacccgcgaccccgcgcagctggaggagcggcgcaagctcatgatggccgcggtgctggtcaccgtggagctcgagtgtctgcagcgcttcttcgcggaccccgagatgcagcgcaagctcgaggagaccctgcactacaccttccgccagggctacgtgcgccaggcctgcaagatctccaacgtggagctctgcaacctggtctcctacctgggcatcctgcacgagaaccgcctcgggcagaacgtcctgcactccaccctcaaaggggaggcgcgccgcgactacatccgcgactgcgcctacctcttcctctgctacacctggcagacggccatgggggtctggcagcagtgcctggaggagcgcaacctcaaggagctggaaaagctcctcaagcgcaccctcagggacctctggacgggcttcaacgagcgctcggtggccgccgcgctggcggacatcatctttcccgagcgcctgctcaagaccctgcagcagggcctgcccgacttcaccagccagagcatgctgcagaacttcaggactttcatcctggagcgctcgggcatcctgccggccacttgctgcgcgctgcccagcgacttcgtgcccatcaagtacagggagtgcccgccgccgctctggggccactgctacctcttccagctggccaactacctcgcctaccactcggacctcatggaagacgtgagcggcgagggcctgctcgagtgccactgccgctgcaacctctgcacgccccaccgctctctagtctgcaacccgcagctgctcagcgagagtcagattatcggtaccttcgagctgcagggtccctcgcctgacgagaagtccgcggctccagggctgaaactcactccggggctgtggacttccgcctacctacgcaaatttgtacctgaggactaccacgcccacgagatcaggttctacgaagaccaatcccgcccgcccaaggcggagctcaccgcctgcgtcatcacccaggggcacatcctgggccaattgcaagccatcaacaaagcccgccgagagttcttgctgaaaaagggtcggggggtgtacctggacccccagtccggcgaggagctaaacccgctacccccgccgccgccccagcagcgggaccttgcttcccaggatggcacccagaaagaagcagcagccgccgccgccgccgcagccatacatgcttctggaggaagaggaggaggactgggacagtcaggcagaggaggtttcggacgaggagcaggaggagatgatggaagactgggaggaggacagcagcctagacgaggaagcttcagaggccgaagaggtggcagacgcaacaccatcgccctcggtcgcagccccctcgccggggcccctgaaatcctccgaacccagcaccagcgctataacctccgctcctccggcgccggcgccacccgcccgcagacccaaccgtagatgggacaccacaggaaccggggtcggtaagtccaagtgcccgccgccgccaccgcagcagcagcagcagcagcgccagggctaccgctcgtggcgcgggcacaagaacgccatagtcgcctgcttgcaagactgcgggggcaacatctctttcgcccgccgcttcctgctattccaccacggggtcgcctttccccgcaatgtcctgcattactaccgtcatctctacagcccctactgcagcggcgacccagaggcggcagcggcagccacagcggcgaccaccacctaggaagatatcctccgcgggcaagacagcggcagcagcggccaggagacccgcggcagcagcggcgggagcggtgggcgcactgcgcctctcgcccaacgaacccctctcgacccgggagctcagacacaggatcttccccactttgtatgccatcttccaacagagcagaggccaggagcaggagctgaaaataaaaaacagatctctgcgctccctcacccgcagctgtctgtatcacaaaagcgaagatcagcttcggcgcacgctggaggacgcggaggcactcttcagcaaatactgcgcgctcactcttaaagactagctccgcgcccttctcgaatttaggcgggagaaaactacgtcatcgccggccgccgcccagcccgcccagccgagatgagcaaagagattcccacgccatacatgtggagctaccagccgcagatgggactcgcggcgggagcggcccaggactactccacccgcatgaactacatgagcgcgggaccccacatgatctcacaggtcaacgggatccgcgcccagcgaaaccaaatactgctggaacaggcggccatcaccgccacgccccgccataatctcaacccccgaaattggcccgccgccctcgtgtaccaggaaaccccctccgccaccaccgtactacttccgcgtgacgcccaggccgaagtccagatgactaactcaggggcgcagctcgcgggcggctttcgtcacggggcgcggccgctccgaccaggtataagacacctgatgatcagaggccgaggtatccagctcaacgacgagtcggtgagctcttcgctcggtctccgtccggacggaactttccagctcgccggatccggccgctcttcgttcacgccccgccaggcgtacctgactctgcagacctcgtcctcggagccccgctccggcggcatcggaaccctccagttcgtggaggagttcgtgccctcggtctacttcaaccccttctcgggacctcccggacgctaccccgaccagttcattccgaactttgacgcggtgaaggactcggcggacggctacgactgaatgtcaggtgtcgaggcagagcagcttcgcctgagacacctcgagcactgccgccgccacaagtgcttcgcccgcggttctggtgagttctgctactttcagctacccgaggagcataccgaggggccggcgcacggcgtccgcctgaccacccagggcgaggttacctgttccctcatccgggagtttaccctccgtcccctgctagtggagcgggagcggggtccctgtgtcctaactatcgcctgcaactgccctaaccctggattacatcaagatctttgctgtcatctctgtgctgagtttaataaacgctgagatcagaatctactggggctcctgtcgccatcctgtgaacgccaccgtcttcacccaccccgaccaggcccaggcgaacctcacctgcggtctgcatcggagggccaagaagtacctcacctggtacttcaacggcaccccctttgtggtttacaacagcttcgacggggacggagtctccctgaaagaccagctctccggtctcagctactccatccacaagaacaccaccctccaactcttccctccctacctgccgggaacctacgagtgcgtcaccggccgctgcacccacctcacccgcctgatcgtaaaccagagctttccgggaacagataactccctcttccccagaacaggaggtgagctcaggaaactccccggggaccagggcggagacgtaccttcgacccttgtggggttaggattttttattaccgggttgctggctcttttaatcaaagtttccttgagatttgttctttccttctacgtgtatgaacacctcaacctccaataactctaccctttcttcggaatcaggtgacttctctgaaatcgggcttggtgtgctgcttactctgttgatttttttccttatcatactcagccttctgtgcctcaggctcgccgcctgctgcgcacacatctatatctactgctggttgctcaagtgcaggggtcgccacccaagatgaacaggtacatggtcctatcgatcctaggcctgctggccctggcggcctgcagcgccgccaaaaaagagattacctttgaggagcccgcttgcaatgtaactttcaagcccgagggtgaccaatgcaccaccctcgtcaaatgcgttaccaatcatgagaggctgcgcatcgactacaaaaacaaaactggccagtttgcggtctatagtgtgtttacgcccggagacccctctaactactctgtcaccgtcttccagggcggacagtctaagatattcaattacactttccctttttatgagttatgcgatgcggtcatgtacatgtcaaaacagtacaacctgtggcctccctctccccaggcgtgtgtggaaaatactgggtcttactgctgtatggctttcgcaatcactacgctcgctctaatctgcacggtgctatacataaaattcaggcagaggcgaatctttatcgatgaaaagaaaatgccttgatcgctaacaccggctttctatctgcagaatgaatgcaatcacctccctactaatcaccaccaccctccttgcgattgcccatgggttgacacgaatcgaagtgccagtggggtccaatgtcaccatggtgggccccgccggcaattccaccctcatgtgggaaaaatttgtccgcaatcaatgggttcatttctgctctaaccgaatcagtatcaagcccagagccatctgcgatgggcaaaatctaactctgatcaatgtgcaaatgatggatgctgggtactattacgggcagcggggagaaatcattaattactggcgaccccacaaggactacatgctgcatgtagtcgaggcacttcccactaccacccccactaccacctctcccaccaccaccaccactactactactactactactactactactactaccactaccgctgcccgccatacccgcaaaagcaccatgattagcacaaagccccctcgtgctcactcccacgccggcgggcccatcggtgcgacctcagaaaccaccgagctttgcttctgccaatgcactaacgccagcgctcatgaactgttcgacctggagaatgaggatgtccagcagagctccgcttgcctgacccaggaggctgtggagcccgttgccctgaagcagatcggtgattcaataattgactcttcttcttttgccactcccgaataccctcccgattctactttccacatcacgggtaccaaagaccctaacctctctttctacctgatgctgctgctctgtatctctgtggtctcttccgcgctgatgttactggggatgttctgctgcctgatctgccgcagaaagagaaaagctcgctctcagggccaaccactgatgcccttcccctaccccccggattttgcagataacaagatatgagctcgctgctgacactaaccgctttactagcctgcgctctaacccttgtcgcttgcgactcgagattccacaatgtcacagctgtggcaggagaaaatgttactttcaactccacggccgatacccagtggtcgtggagtggctcaggtagctacttaactatctgcaatagctccacttcccccggcatatccccaaccaagtaccaatgcaatgccagcctgttcaccctcatcaacgcttccaccctggacaatggactctatgtaggctatgtaccctttggtgggcaaggaaagacccacgcttacaacctggaagttcgccagcccagaaccactacccaagcttctcccaccaccaccaccaccaccaccatcaccagcagcagcagcagcagcagccacagcagcagcagcagattattgactttggttttggccagctcatctgccgctacccaggccatctacagctctgtgcccgaaaccactcagatccaccgcccagaaacgaccaccgccaccaccctacacacctccagcgatcagatgccgaccaacatcacccccttggctcttcaaatgggacttacaagccccactccaaaaccagtggatgcggccgaggtctccgccctcgtcaatgactgggcggggctgggaatgtggtggttcgccataggcatgatggcgctctgcctgcttctgctctggctcatctgctgcctccaccgcaggcgagccagaccccccatctatagacccatcattgtcctgaaccccgataatgatgggatccatagattggatggcctgaaaaacctacttttttcttttacagtatgataaattgagacatgcctcgcattttcttgtacatgttccttctcccaccttttctggggtgttctacgctggccgctgtgtctcacctggaggtagactgcctctcacccttcactgtctacctgctttacggattggtcaccctcactctcatctgcagcctaatcacagtaatcatcgccttcatccagtgcattgattacatctgtgtgcgcctcgcatacttcagacaccacccgcagtaccgagacaggaacattgcccaacttctaagactgctctaatcatgcataagactgtgatctgccttctgatcctctgcatcctgcccaccctcacctcctgccagtacaccacaaaatctccgcgcaaaagacatgcctcctgccgcttcacccaactgtggaatatacccaaatgctacaacgaaaagagcgagctctccgaagcttggctgtatggggtcatctgtgtcttagttttctgcagcactgtctttgccctcataatctacccctactttgatttgggatggaacgcgatcgatgccatgaattaccccacctttcccgcacccgagataattccactgcgacaagttgtacccgttgtcgttaatcaacgccccccatcccctacgcccactgaaatcagctactttaacctaacaggcggagatgactgacgccctagatctagaaatggacggcatcagtaccgagcagcgtctcctagagaggcgcaggcaggcggctgagcaagagcgcctcaatcaggagctccgagatctcgttaacctgcaccagtgcaaaagaggcatcttttgtctggtaaagcaggccaaagtcacctacgagaagaccggcaacagccaccgcctcagttacaaattgcccacccagcgccagaagctggtgctcatggtgggtgagaatcccatcaccgtcacccagcactcggtagagaccgaggggtgtctgcactccccctgtcggggtccagaagacctctgcaccctggtaaagaccctgtgcggtctcagagatttagtcccctttaactaatcaaacactggaatcaataaaaagaatcacttacttaaaatcagacagcaggtctctgtccagtttattcagcagcacctccttcccctcctcccaactctggtactccaaacgccttctggcggcaaacttcctccacaccctgaagggaatgtcagattcttgctcctgtccctccgcacccactatcttcatgttgttgcagatgaagcgcaccaaaacgtctgacgagagcttcaaccccgtgtacccctatgacacggaaagcggccctccctccgtccctttcctcacccctcccttcgtgtctcccgatggattccaagaaagtccccccggggtcctgtctctgaacctggccgagcccctggtcacttcccacggcatgctcgccctgaaaatgggaagtggcctctccctggacgacgctggcaacctcacctctcaagatatcaccaccgctagccctcccctcaaaaaaaccaagaccaacctcagcctagaaacctcatcccccctaactgtgagcacctcaggcgccctcaccgtagcagccgccgctcccctggcggtggccggcacctccctcaccatgcaatcagaggcccccctgacagtacaggatgcaaaactcaccctggccaccaaaggccccctgaccgtgtctgaaggcaaactggccttgcaaacatcggccccgctgacggccgctgacagcagcaccctcacagtcagtgccacaccaccccttagcacaagcaatggcagcttgggtattgacatgcaagcccccatttacaccaccaatggaaaactaggacttaactttggcgctcccctgcatgtggtagacagcctaaatgcactgactgtagttactggccaaggtcttacgataaacggaacagccctacaaactagagtctcaggtgccctcaactatgacacatcaggaaacctagaattgagagctgcagggggtatgcgagttgatgcaaatggtcaacttatccttgatgtagcttacccatttgatgcacaaaacaatctcagccttaggcttggacagggacccctgtttgttaactctgcccacaacttggatgttaactacaacagaggcctctacctgttcacatctggaaataccaaaaagctagaagttaatatcaaaacagccaagggtctcatttatgatgacactgctatagcaatcaatgcgggtgatgggctacagtttgactcaggctcagatacaaatccattaaaaactaaacttggattaggactggattatgactccagcagagccataattgctaaactgggaactggcctaagctttgacaacacaggtgccatcacagtaggcaacaaaaatgatgacaagcttaccttgtggaccacaccagacccatcccctaactgtagaatctattcagagaaagatgctaaattcacacttgttttgactaaatgcggcagtcaggtgttggccagcgtttctgttttatctgtaaaaggtagccttgcgcccatcagtggcacagtaactagtgctcagattgtcctcagatttgatgaaaatggagttctactaagcaattcttcccttgaccctcaatactggaactacagaaaaggtgaccttacagagggcactgcatataccaacgcagtgggatttatgcccaacctcacagcatacccaaaaacacagagccaaactgctaaaagcaacattgtaagtcaggtttacttgaatggggacaaatccaaacccatgaccctcaccattaccctcaatggaactaatgaaacaggagatgccacagtaagcacttactccatgtcattctcatggaactggaatggaagtaattacattaatgaaacgttccaaaccaactccttcaccttctcctacatcgcccaagaataaaaagcatgacgctgttgatttgattcaatgtgtttctgttttattttcaagcacaacaaaatcattcaagtcattcttccatcttagcttaatagacacagtagcttaatagacccagtagtgcaaagccccattctagcttataactagtggagaagtactcgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagtcttagatctctcaacgcagcaccagcaccaacacttcgcagtgtaaaaggccaagtgccgagagagtatatataggaataaaaagtgacgtaaacgggcaaagtccaaaaaacgcccagaaaaaccgcacgcgaacctacgccccgaaacgaaagccaaaaaacactagacactcccttccggcgtcaacttccgctttcccacgctacgtcacttgccccagtcaaacaaactacatatcccgaacttccaagtcgccacgcccaaaacaccgcctacacctccccgcccgccggcccgcccccaaacccgcctcccgccccgcgccccgccccgcgccgcccatctcattatcatattggcttcaatccaaaataaggtatattattgatgatggtttaaacggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgatgcggccgcaaggggttcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcctcgtttaaac

SEQ ID NO: 9 - DNA, 45227 bp, Artificial
  synthetic polynucleotide
catcatcaataatataccttattttggattgaagccaatatgataatgagatgggcggcgcggggcggggcgcggggcgggaggcgggtttgggggcgggccggcgggcggggcggtgtggcggaagtggactttgtaagtgtggcggatgtgacttgctagtgccgggcgcggtaaaagtgacgttttccgtgcgcgacaacgcccccgggaagtgacatttttcccgcggtttttaccggatgttgtagtgaatttgggcgtaaccaagtaagatttggccattttcgcgggaaaactgaaacggggaagtgaaatctgattaattttgcgttagtcataccgcgtaatatttgtctagggccgagggactttggccgattacgtggaggactcgcccaggtgttttttgaggtgaatttccgcgttccgggtcaaagtctgcgttttattattataggatatcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccgcggccgggaacggtgcattggaacgcggattccccgtgccaagagtgagatcttccgtttatctaggtaccgggccccccctcgaggtcgacggtatcgataagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctaaccaggagctatttaatggcaacagttaaccagctggtacgcaaaccacgtgctcgcaaagttgcgaaaagcaacgtgcctgcgctggaagcatgcccgcaaaaacgtggcgtatgtactcgtgtatatactaccactcctaaaaaaccgaactccgcgctgcgtaaagtatgccgtgttcgtctgactaacggtttcgaagtgacttcctacatcggtggtgaaggtcacaacctgcaggagcactccgtgatcctgatccgtggcggtcgtgttaaagacctcccgggtgttcgttaccacaccgtacgtggtgcgcttgactgctccggcgttaaagaccgtaagcaggctcgttccaagtatggcgtgaagcgtcctaaggcttaatggtagatctgatcaagagacaggatgacggtcgtttcgcatgcttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccgggctcgatcccctcggggggaatcagaattcagtcgacagcggccgcgatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggccgatcagcgatcgctgaggtgggtgagtgggcgtggcctggggtggtcatgaaaatatataagttgggggtcttagggtctctttatttgtgttgcagagaccgccggagccatgagcgggagcagcagcagcagcagtagcagcagcgccttggatggcagcatcgtgagcccttatttgacgacgcggatgccccactgggccggggtgcgtcagaatgtgatgggctccagcatcgacggccgacccgtcctgcccgcaaattccgccacgctgacctatgcgaccgtcgcggggacgccgttggacgccaccgccgccgccgccgccaccgcagccgcctcggccgtgcgcagcctggccacggactttgcattcctgggaccactggcgacaggggctacttctcgggccgctgctgccgccgttcgcgatgacaagctgaccgccctgctggcgcagttggatgcgcttactcgggaactgggtgacctttctcagcaggtcatggccctgcgccagcaggtctcctccctgcaagctggcgggaatgcttctcccacaaatgccgtttaagataaataaaaccagactctgtttggattaaagaaaagtagcaagtgcattgctctctttatttcataattttccgcgcgcgataggccctagaccagcgttctcggtcgttgagggtgcggtgtatcttctccaggacgtggtagaggtggctctggacgttgagatacatgggcatgagcccgtcccgggggtggaggtagcaccactgcagagcttcatgctccggggtggtgttgtagatgatccagtcgtagcaggagcgctgggcatggtgcctaaaaatgtccttcagcagcaggccgatggccagggggaggcccttggtgtaagtgtttacaaaacggttaagttgggaagggtgcattcggggagagatgatgtgcatcttggactgtatttttagattggcgatgtttccgcccagatcccttctgggattcatgttgtgcaggaccaccagtacagtgtatccggtgcacttggggaatttgtcatgcagcttagagggaaaagcgtggaagaacttggagacgcctttgtggcctcccagattttccatgcattcgtccatgatgatggcaatgggcccgcgggaggcagcttgggcaaagatatttctggggtcgctgacgtcgtagttgtgttccagggtgaggtcgtcataggccatttttacaaagcgcgggcggagggtgcccgactgggggatgatggtcccctctggccctggggcgtagttgccctcgcagatctgcatttcccaggccttaatctcggaggggggaatcatatccacctgcggggcgatgaagaaaacggtttccggagccggggagattaactgggatgagagcaggtttctaagcagctgtgattttccacaaccggtgggcccataaataacacctataaccggttgcagctggtagtttagagagctgcagctgccgtcgtcccggaggaggggggccacctcgttgagcatgtccctgacgcgcatgttctccccgaccagatccgccagaaggcgctcgccgcccagggacagcagctcttgcaaggaagcaaagtttttcagcggcttgaggccgtccgccgtgggcatgtttttcagggtctggctcagcagctccaggcggtcccagagctcggtgacgtgctctacggcatctctatccagcatatctcctcgtttcgcgggttggggcgactttcgctgtagggcaccaagcggtggtcgtccagcggggccagagtcatgtccttccatgggcgcagggtcctcgtcagggtggtctgggtcacggtgaaggggtgcgctccgggctgagcgcttgccaaggtgcgcttgaggctggttctgctggtgctgaagcgctgccggtcttcgccctgcgcgtcggccaggtagcatttgaccatggtgtcatagtccagcccctccgcggcgtgtcccttggcgcgcagcttgcccttggaggtggcgccgcacgaggggcagagcaggctcttgagcgcgtagagcttgggggcgaggaagaccgattcgggggagtaggcgtccgcgccgcagaccccgcacacggtctcgcactccaccagccaggtgagctcggggcgcgccgggtcaaaaaccaggtttcccccatgctttttgatgcgtttcttacctcgggtctccatgaggtggtgtccccgctcggtgacgaagaggctgtccgtgtctccgtagaccgacttgaggggtcttttctccaggggggtccctcggtcttcctcgtagaggaactcggaccactctgagacgaaggcccgcgtccaggccaggacgaaggaggctatgtgggaggggtagcggtcgttgtccactagggggtccaccttctccaaggtgtgaagacacatgtcgccttcctcggcgtccaggaaggtgattggcttgtaggtgtaggccacgtgaccgggggttcctgacgggggggtataaaagggggtgggggcgcgctcgtcgtcactctcttccgcatcgctgtctgcgagggccagctgctggggtgagtattccctctcgaaggcgggcatgacctccgcgctgaggttgtcagtttccaaaaacgaggaggatttgatgttcacctgtcccgaggtgatacctttgagggtacccgcgtccatctggtcagaaaacacgatctttttattgtccagcttggtggcgaacgacccgtagagggcgttggagagcagcttggcgatggagcgcagggtctggttcttgtccctgtcggcgcgctccttggccgcgatgttgagctgcacgtactcgcgcgcgacgcagcgccactcggggaagacggtggtgcgctcgtcgggcaccaggcgcacgcgccagccgcggttgtgcagggtgaccaggtccacgctggtggcgacctcgccgcgcaggcgctcgttggtccagcagagacggccgcccttgcgcgagcagaaggggggcagggggtcgagctgggtctcgtccggggggtccgcgtccacggtgaaaaccccggggcgcaggcgcgcgtcgaagtagtctatcttgcaaccttgcatgtccagcgcctgctgccagtcgcgggcggcgagcgcgcgctcgtaggggttgagcggcgggccccagggcatggggtgggtgagtgcggaggcgtacatgccgcagatgtcatagacgtagaggggctcccgcaggaccccgatgtaggtggggtagcagcggccgccgcggatgctggcgcgcacgtagtcatacagctcgtgcgagggggcgaggaggtcggggcccaggttggtgcgggcggggcgctccgcgcggaagacgatctgcctgaagatggcatgcgagttggaagagatggtggggcgctggaagacgttgaagctggcgtcctgcaggccgacggcgtcgcgcacgaaggaggcgtaggagtcgcgcagcttgtgtaccagctcggcggtgacctgcacgtcgagcgcgcagtagtcgagggtctcgcggatgatgtcatatttagcctgccccttctttttccacagctcgcggttgaggacaaactcttcgcggtctttccagtactcttggatcgggaaaccgtccggttccgaacggtaagagcctagcatgtagaactggttgacggcctggtaggcgcagcagcccttctccacggggagggcgtaggcctgcgcggccttgcggagcgaggtgtgggtcagggcgaaggtgtccctgaccatgactttgaggtactggtgcttgaagtcggagtcgtcgcagccgccccgctcccagagcgagaagtcggtgcgcttcttggagcgggggttgggcagagcgaaggtgacatcgttgaagaggattttgcccgcgcggggcatgaagttgcgggtgatgcggaagggccccggcacttcagagcggttgttgatgacctgggcggcgagcacgatctcgtcgaagccgttgatgttgtggcccacgatgtagagttccaggaagcggggccggccctttacggtgggcagcttctttagctcttcgtaggtgagctcctcgggcgaggcgaggccgtgctcggccagggcccagtccgcgaggtgcgggttgtctctgaggaaggacttccagaggtcgcgggccaggagggtctgcaggcggtctctgaaggtcctgaactggcggcccacggccattttttcgggggtgatgcagtagaaggtgagggggtcttgctgccagcggtcccagtcgagctgcagggcgaggtcgcgcgcggcggtgaccaggcgctcgtcgcccccgaatttcatgaccagcatgaagggcacgagctgctttccgaaggcccccatccaagtgtaggtctctacatcgtaggtgacaaagaggcgctccgtgcgaggatgcgagccgatcgggaagaactggatctcccgccaccagttggaggagtggctgttgatgtggtggaagtagaagtcccgtcgccgggccgaacactcgtgctggcttttgtaaaagcgagcgcagtactggcagcgctgcacgggctgtacctcatgcacgagatgcacctttcgcccgcgcacgaggaagccgaggggaaatctgagccccccgcctggctcgcggcatggctggttctcttctactttggatgcgtgtccgtctccgtctggctcctcgaggggtgttacggtggagcggaccaccacgccgcgcgagccgcaggtccagatatcggcgcgcggcggtcggagtttgatgacgacatcgcgcagctgggagctgtccatggtctggagctcccgcggcggcggcaggtcagccgggagttcttgcaggttcacctcgcagagtcgggccagggcgcggggcaggtctaggtggtacctgatctctaggggcgtgttggtggcggcgtcgatggcttgcaggagcccgcagccccggggggcgacgacggtgccccgcggggtggtggtggtggtggcggtgcagctcagaagcggtgccgcgggcgggcccccggaggtagggggggctccggtcccgcgggcaggggcggcagcggcacgtcggcgtggagcgcgggcaggagttggtgctgtgcccggaggttgctggcgaaggcgacgacgcggcggttgatctcctggatctggcgcctctgcgtgaagacgacgggcccggtgagcttgaacctgaaagagagttcgacagaatcaatctcggtgtcattgaccgcggcctggcgcaggatctcctgcacgtctcccgagttgtcttggtaggcgatctcggccatgaactgctcgatctcttcctcctggaggtctccgcgtccggcgcgttccacggtggccgccaggtcgttggagatgcgccccatgagctgcgagaaggcgttgagtccgccctcgttccagactcggctgtagaccacgcccccctggtcatcgcgggcgcgcatgaccacctgcgcgaggttgagctccacgtgccgcgcgaagacggcgtagttgcgcagacgctggaagaggtagttgagggtggtggcggtgtgctcggccacgaagaagttcatgacccagcggcgcaacgtggattcgttgatgtcccccaaggcctccagccgttccatggcctcgtagaagtccacggcgaagttgaaaaactgggagttgcgcgccgacacggtcaactcctcctccagaagacggatgagctcggcgacggtgtcgcgcacctcgcgctcgaaggctatggggatctcttcctccgctagcatcaccacctcctcctcttcctcctcttctggcacttccatgatggcttcctcctcttcggggggtggcggcggcggcggtgggggagggggcgctctgcgccggcggcggcgcaccgggaggcggtccacgaagcgcgcgatcatctccccgcggcggcggcgcatggtctcggtgacggcgcggccgttctcccgggggcgcagttggaagacgccgccggacatctggtgctggggcgggtggccgtgaggcagcgagacggcgctgacgatgcatctcaacaattgctgcgtaggtacgccgccgagggacctgagggagtccatatccaccggatccgaaaacctttcgaggaaggcgtctaaccagtcgcagtcgcaaggtaggctgagcaccgtggcgggcggcggggggtggggggagtgtctggcggaggtgctgctgatgatgtaattgaagtaggcggacttgacacggcggatggtcgacaggagcaccatgtccttgggtccggcctgctggatgcggaggcggtcggctatgccccaggcttcgttctggcatcggcgcaggtccttgtagtagtcttgcatgagcctttccaccggcacctcttctccttcctcttctgcttcttccatgtctgcttcggccctggggcggcgccgcgcccccctgccccccatgcgcgtgaccccgaaccccctgagcggttggagcagggccaggtcggcgacgacgcgctcggccaggatggcctgctgcacctgcgtgagggtggtttggaagtcatccaagtccacgaagcggtggtaggcgcccgtgttgatggtgtaggtgcagttggccatgacggaccagttgacggtctggtggcccggttgcgacatctcggtgtacctgagtcgcgagtaggcgcgggagtcgaagacgtagtcgttgcaagtccgcaccaggtactggtagcccaccaggaagtgcggcggcggctggcggtagaggggccagcgcagggtggcgggggctccgggggccaggtcttccagcatgaggcggtggtaggcgtagatgtacctggacatccaggtgatacccgcggcggtggtggaggcgcgcgggaagtcgcgcacccggttccagatgttgcgcaggggcagaaagtgctccatggtaggcgtgctctgtccagtcagacgcgcgcagtcgttgatactctagaccagggaaaacgaaagccggtcagcgggcactcttccgtggtctggtgaatagatcgcaagggtatcatggcggagggcctcggttcgagccccgggtccgggccggacggtccgccatgatccacgcggttaccgcccgcgtgtcgaacccaggtgtgcgacgtcagacaacggtggagtgttccttttggcgtttttctggccgggcgccggcgccgcgtaagagactaagccgcgaaagcgaaagcagtaagtggctcgctccccgtagccggagggatccttgctaagggttgcgttgcggcgaaccccggttcgaatcccgtactcgggccggccggacccgcggctaaggtgttggattggcctccccctcgtataaagaccccgcttgcggattgactccggacacggggacgagccccttttatttttgctttccccagatgcatccggtgctgcggcagatgcgccccccgccccagcagcagcaacaacaccagcaagagcggcagcaacagcagcgggagtcatgcagggccccctcacccaccctcggcgggccggccacctcggcgtccgcggccgtgtctggcgcctgcggcggcggcggggggccggctgacgaccccgaggagcccccgcggcgcagggccagacactacctggacctggaggagggcgagggcctggcgcggctgggggcgccgtctcccgagcgccacccgcgggtgcagctgaagcgcgactcgcgcgaggcgtacgtgcctcggcagaacctgttcagggaccgcgcgggcgaggagcccgaggagatgcgggacaggaggttcagcgcagggcgggagctgcggcaggggctgaaccgcgagcggctgctgcgcgaggaggactttgagcccgacgcgcggacggggatcagccccgcgcgcgcgcacgtggcggccgccgacctggtgacggcgtacgagcagacggtgaaccaggagatcaacttccaaaagagtttcaacaaccacgtgcgcacgctggtggcgcgcgaggaggtgaccatcgggctgatgcacctgtgggactttgtaagcgcgctggtgcagaaccccaacagcaagcctctgacggcgcagctgttcctgatagtgcagcacagcagggacaacgaggcgtttagggacgcgctgctgaacatcaccgagcccgagggtcggtggctgctggacctgattaacatcctgcagagcatagtggtgcaggagcgcagcctgagcctggccgacaaggtggcggccatcaactactcgatgctgagcctgggcaagttttacgcgcgcaagatctaccagacgccgtacgtgcccatagacaaggaggtgaagatcgacggtttttacatgcgcatggcgctgaaggtgctcaccctgagcgacgacctgggcgtgtaccgcaacgagcgcatccacaaggccgtgagcgtgagccggcggcgcgagctgagcgaccgcgagctgatgcacagcctgcagcgggcgctggcgggcgccggcagcggcgacagggaggcggagtcctacttcgatgcgggggcggacctgcgctgggcgcccagccggcgggccctggaggccgcgggggtccgcgaggactatgacgaggacggcgaggaggatgaggagtacgagctagaggagggcgagtacctggactaaaccgcgggtggtgtttccggtagatgcaagacccgaacgtggtggacccggcgctgcgggcggctctgcagagccagccgtccggccttaactcctcagacgactggcgacaggtcatggaccgcatcatgtcgctgacggcgcgtaacccggacgcgttccggcagcagccgcaggccaacaggctctccgccatcctggaggcggtggtgcctgcgcgctcgaaccccacgcacgagaaggtgctggccatagtgaacgcgctggccgagaacagggccatccgcccggacgaggccgggctggtgtacgacgcgctgctgcagcgcgtggcccgctacaacagcggcaacgtgcagaccaacctggaccggctggtgggggacgtgcgcgaggcggtggcgcagcgcgagcgcgcggatcggcagggcaacctgggctccatggtggcgctgaatgccttcctgagcacgcagccggccaacgtgccgcgggggcaggaagactacaccaactttgtgagcgcgctgcggctgatggtgaccgagaccccccagagcgaggtgtaccagtcgggcccggactacttcttccagaccagcagacagggcctgcagacggtgaacctgagccaggctttcaagaacctgcgggggctgtggggcgtgaaggcgcccaccggcgaccgggcgacggtgtccagcctgctgacgcccaactcgcgcctgctgctgctgctgatcgcgccgttcacggacagcggcagcgtgtcccgggacacctacctggggcacctgctgaccctgtaccgcgaggccatcgggcaggcgcaggtggacgagcacaccttccaggagatcaccagcgtgagccgcgcgctggggcaggaggacacgagcagcctggaggcgactctgaactacctgctgaccaaccggcggcagaagattccctcgctgcacagcctgacctccgaggaggagcgcatcttgcgctacgtgcagcagagcgtgagcctgaacctgatgcgcgacggggtgacgcccagcgtggcgctggacatgaccgcgcgcaacatggaaccgggcatgtacgccgcgcaccggccttacatcaaccgcctgatggactacctgcatcgcgcggcggccgtgaaccccgagtactttaccaacgccatcctgaacccgcactggctcccgccgcccgggttctacagcgggggcttcgaggtcccggagaccaacgatggcttcctgtgggacgacatggacgacagcgtgttctccccgcggccgcaggcgctggcggaagcgtccctgctgcgtcccaagaaggaggaggaggaggaggcgagtcgccgccgcggcagcagcggcgtggcttctctgtccgagctgggggcggcagccgccgcgcgccccgggtccctgggcggcagcccctttccgagcctggtggggtctctgcacagcgagcgcaccacccgccctcggctgctgggcgaggacgagtacctgaataactccctgctgcagccggtgcgggagaaaaacctgcctcccgccttccccaacaacgggatagagagcctggtggacaagatgagcagatggaagacctatgcgcaggagcacagggacgcgcctgcgctccggccgcccacgcggcgccagcgccacgaccggcagcgggggctggtgtgggatgacgaggactccgcggacgatagcagcgtgctggacctgggagggagcggcaacccgttcgcgcacctgcgcccccgcctggggaggatgttttaaaaaaaaaaaaaaaaagcaagaagcatgatgcaaaaattaaataaaactcaccaaggccatggcgaccgagcgttggtttcttgtgttcccttcagtatgcggcgcgcggcgatgtaccaggagggacctcctccctcttacgagagcgtggtgggcgcggcggcggcggcgccctcttctccctttgcgtcgcagctgctggagccgccgtacgtgcctccgcgctacctgcggcctacgggggggagaaacagcatccgttactcggagctggcgcccctgttcgacaccacccgggtgtacctggtggacaacaagtcggcggacgtggcctccctgaactaccagaacgaccacagcaattttttgaccacggtcatccagaacaatgactacagcccgagcgaggccagcacccagaccatcaatctggatgaccggtcgcactggggcggcgacctgaaaaccatcctgcacaccaacatgcccaacgtgaacgagttcatgttcaccaataagttcaaggcgcgggtgatggtgtcgcgctcgcacaccaaggaagaccgggtggagctgaagtacgagtgggtggagttcgagctgccagagggcaactactccgagaccatgaccattgacctgatgaacaacgcgatcgtggagcactatctgaaagtgggcaggcagaacggggtcctggagagcgacatcggggtcaagttcgacaccaggaacttccgcctggggctggaccccgtgaccgggctggttatgcccggggtgtacaccaacgaggccttccatcccgacatcatcctgctgcccggctgcggggtggacttcacttacagccgcctgagcaacctcctgggcatccgcaagcggcagcccttccaggagggcttcaggatcacctacgaggacctggaggggggcaacatccccgcgctcctcgatgtggaggcctaccaggatagcttgaaggaaaatgaggcgggacaggaggataccgcccccgccgcctccgccgccgccgagcagggcgaggatgctgctgacaccgcggccgcggacggggcagaggccgaccccgctatggtggtggaggctcccgagcaggaggaggacatgaatgacagtgcggtgcgcggagacaccttcgtcacccggggggaggaaaagcaagcggaggccgaggccgcggccgaggaaaagcaactggcggcagcagcggcggcggcggcgttggccgcggcggaggctgagtctgaggggaccaagcccgccaaggagcccgtgattaagcccctgaccgaagatagcaagaagcgcagttacaacctgctcaaggacagcaccaacaccgcgtaccgcagctggtacctggcctacaactacggcgacccgtcgacgggggtgcgctcctggaccctgctgtgcacgccggacgtgacctgcggctcggagcaggtgtactggtcgctgcccgacatgatgcaagaccccgtgaccttccgctccacgcggcaggtcagcaacttcccggtggtgggcgccgagctgctgcccgtgcactccaagagcttctacaacgaccaggccgtctactcccagctcatccgccagttcacctctctgacccacgtgttcaatcgctttcctgagaaccagattctggcgcgcccgcccgcccccaccatcaccaccgtcagtgaaaacgttcctgctctcacagatcacgggacgctaccgctgcgcaacagcatcggaggagtccagcgagtgaccgttactgacgccagacgccgcacctgcccctacgtttacaaggccttgggcatagtctcgccgcgcgtcctttccagccgcactttttgagcaacaccaccatcatgtccatcctgatctcacccagcaataactccggctggggactgctgcgcgcgcccagcaagatgttcggaggggcgaggaagcgttccgagcagcaccccgtgcgcgtgcgcgggcacttccgcgccccctggggagcgcacaaacgcggccgcgcggggcgcaccaccgtggacgacgccatcgactcggtggtggagcaggcgcgcaactacaggcccgcggtctctaccgtggacgcggccatccagaccgtggtgcggggcgcgcggcggtacgccaagctgaagagccgccggaagcgcgtggcccgccgccaccgccgccgacccggggccgccgccaaacgcgccgccgcggccctgcttcgccgggccaagcgcacgggccgccgcgccgccatgagggccgcgcgccgcttggccgccggcatcaccgccgccaccatggccccccgtacccgaagacgcgcggccgccgccgccgccgccgccatcagtgacatggccagcaggcgccggggcaacgtgtactgggtgcgcgactcggtgaccggcacgcgcgtgcccgtgcgcttccgccccccgcggacttgagatgatgtgaaaaaacaacactgagtctcctgctgttgtgtgtatcccagcggcggcggcgcgcgcagcgtcatgtccaagcgcaaaatcaaagaagagatgctccaggtcgtcgcgccggagatctatgggcccccgaagaaggaagagcaggattcgaagccccgcaagataaagcgggtcaaaaagaaaaagaaagatgatgacgatgccgatggggaggtggagttcctgcgcgccacggcgcccaggcgcccggtgcagtggaagggccggcgcgtaaagcgcgtcctgcgccccggcaccgcggtggtcttcacgcccggcgagcgctccacccggactttcaagcgcgtctatgacgaggtgtacggcgacgaagacctgctggagcaggccaacgagcgcttcggagagtttgcttacgggaagcgtcagcgggcgctggggaaggaggacctgctggcgctgccgctggaccagggcaaccccacccccagtctgaagcccgtgaccctgcagcaggtgctgccgagcagcgcaccctccgaggcgaagcggggtctgaagcgcgagggcggcgacctggcgcccaccgtgcagctcatggtgcccaagcggcagaggctggaggatgtgctggagaaaatgaaagtagaccccggtctgcagccggacatcagggtccgccccatcaagcaggtggcgccgggcctcggcgtgcagaccgtggacgtggtcatccccaccggcaactcccccgccgccgccaccactaccgctgcctccacggacatggagacacagaccgatcccgccgcagccgcagccgcagccgccgccgcgacctcctcggcggaggtgcagacggacccctggctgccgccggcgatgtcagctccccgcgcgcgtcgcgggcgcaggaagtacggcgccgccaacgcgctcctgcccgagtacgccttgcatccttccatcgcgcccacccccggctaccgaggctatacctaccgcccgcgaagagccaagggttccacccgccgtccccgccgacgcgccgccgccaccacccgccgccgccgccgcagacgccagcccgcactggctccagtctccgtgaggaaagtggcgcgcgacggacacaccctggtgctgcccagggcgcgctaccaccccagcatcgtttaaaagcctgttgtggttcttgcagatatggccctcacttgccgcctccgtttcccggtgccgggataccgaggaggaagatcgcgccgcaggaggggtctggccggccgcggcctgagcggaggcagccgccgcgcgcaccggcggcgacgcgccaccagccgacgcatgcgcggcggggtgctgcccctgttaatccccctgatcgccgcggcgatcggcgccgtgcccgggatcgcctccgtggccttgcaagcgtcccagaggcattgacagacttgcaaacttgcaaatatggaaaaaaaaaccccaataaaaaagtctagactctcacgctcgcttggtcctgtgactattttgtagaatggaagacatcaactttgcgtcgctggccccgcgtcacggctcgcgcccgttcctgggacactggaacgatatcggcaccagcaacatgagcggtggcgccttcagttggggctctctgtggagcggcattaaaagtatcgggtctgccgttaaaaattacggctcccgggcctggaacagcagcacgggccagatgttgagagacaagttgaaagagcagaacttccagcagaaggtggtggagggcctggcctccggcatcaacggggtggtggacctggccaaccaggccgtgcagaataagatcaacagcagactggacccccggccgccggtggaggaggtgccgccggcgctggagacggtgtcccccgatgggcgtggcgagaagcgcccgcggcccgatagggaagagaccactctggtcacgcagaccgatgagccgcccccgtatgaggaggccctgaagcaaggtctgcccaccacgcggcccatcgcgcccatggccaccggggtggtgggccgccacacccccgccacgctggacttgcctccgcccgccgatgtgccgcagcagcagaaggcggcacagccgggcccgcccgcgaccgcctcccgttcctccgccggtcctctgcgccgcgcggccagcggcccccgcgggggggtcgcgaggcacggcaactggcagagcacgctgaacagcatcgtgggtctgggggtgcggtccgtgaagcgccgccgatgctactgaatagcttagctaacgtgttgtatgtgtgtatgcgccctatgtcgccgccagaggagctgctgagtcgccgccgttcgcgcgcccaccaccaccgccactccgcccctcaagatggcgaccccatcgatgatgccgcagtggtcgtacatgcacatctcgggccaggacgcctcggagtacctgagccccgggctggtgcagttcgcccgcgccaccgagagctacttcagcctgagtaacaagtttaggaaccccacggtggcgcccacgcacgatgtgaccaccgaccggtctcagcgcctgacgctgcggttcattcccgtggaccgcgaggacaccgcgtactcgtacaaggcgcggttcaccctggccgtgggcgacaaccgcgtgctggacatggcctccacctactttgacatccgcggggtgctggaccggggtcccactttcaagccctactctggcaccgcctacaactccctggcccccaagggcgctcccaactcctgcgagtgggagcaagaggaaactcaggcagttgaagaagcagcagaagaggaagaagaagatgctgacggtcaagctgaggaagagcaagcagctaccaaaaagactcatgtatatgctcaggctcccctttctggcgaaaaaattagtaaagatggtctgcaaataggaacggacgctacagctacagaacaaaaacctatttatgcagaccctacattccagcccgaaccccaaatcggggagtcccagtggaatgaggcagatgctacagtcgccggcggtagagtgctaaagaaatctactcccatgaaaccatgctatggttcctatgcaagacccacaaatgctaatggaggtcagggtgtactaacggcaaatgcccagggacagctagaatctcaggttgaaatgcaattcttttcaacttctgaaaacgcccgtaacgaggctaacaacattcagcccaaattggtgctgtatagtgaggatgtgcacatggagaccccggatacgcacctttcttacaagcccgcaaaaagcgatgacaattcaaaaatcatgctgggtcagcagtccatgcccaacagacctaattacatcggcttcagagacaactttatcggcctcatgtattacaatagcactggcaacatgggagtgcttgcaggtcaggcctctcagttgaatgcagtggtggacttgcaagacagaaacacagaactgtcctaccagctcttgcttgattccatgggtgacagaaccagatacttttccatgtggaatcaggcagtggacagttatgacccagatgttagaattattgaaaatcatggaactgaagacgagctccccaactattgtttccctctgggtggcataggggtaactgacacttaccaggctgttaaaaccaacaatggcaataacgggggccaggtgacttggacaaaagatgaaacttttgcagatcgcaatgaaataggggtgggaaacaatttcgctatggagatcaacctcagtgccaacctgtggagaaacttcctgtactccaacgtggcgctgtacctaccagacaagcttaagtacaacccctccaatgtggacatctctgacaaccccaacacctacgattacatgaacaagcgagtggtggccccggggctggtggactgctacatcaacctgggcgcgcgctggtcgctggactacatggacaacgtcaaccccttcaaccaccaccgcaatgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggtaacgatctcagggtggacggggccagcatcaagttcgagagcatctgcctctacgccaccttcttccccatggcccacaacacggcctccacgctcgaggccatgctcaggaacgacaccaacgaccagtccttcaatgactacctctccgccgccaacatgctctaccccatacccgccaacgccaccaacgtccccatctccatcccctcgcgcaactgggcggccttccgcggctgggccttcacccgcctcaagaccaaggagaccccctccctgggctcgggattcgacccctactacacctactcgggctccattccctacctggacggcaccttctacctcaaccacactttcaagaaggtctcggtcaccttcgactcctcggtcagctggccgggcaacgaccgtctgctcacccccaacgagttcgagatcaagcgctcggtcgacggggagggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctatccgctcataggcaagaccgcggtcgacagcatcacccagaaaaagttcctctgcgaccgcaccctctggcgcatccccttctccagcaacttcatgtccatgggtgcgctctcggacctgggccagaacttgctctacgccaactccgcccacgccctcgacatgaccttcgaggtcgaccccatggacgagcccacccttctctatgttctgttcgaagtctttgacgtggtccgggtccaccagccgcaccgcggcgtcatcgagaccgtgtacctgcgtacgcccttctcggccggcaacgccaccacctaaagaagcaagccgcagtcatcgccgcctgcatgccgtcgggttccaccgagcaagagctcagggccatcgtcagagacctgggatgcgggccctattttttgggcaccttcgacaagcgcttccctggctttgtctccccacacaagctggcctgcgccatcgtcaacacggccggccgcgagaccgggggcgtgcactggctggccttcgcctggaacccgcgctccaaaacatgcttcctctttgaccccttcggcttttcggaccagcggctcaagcaaatctacgagttcgagtacgagggcttgctgcgtcgcagcgccatcgcctcctcgcccgaccgctgcgtcaccctcgaaaagtccacccagaccgtgcaggggcccgactcggccgcctgcggtctcttctgctgcatgtttctgcacgcctttgtgcactggcctcagagtcccatggaccgcaaccccaccatgaacttgctgacgggggtgcccaactccatgctccagagcccccaggtcgagcccaccctgcgccgcaaccaggagcagctctacagcttcctggagcgccactcgccttacttccgccgccacagcgcacagatcaggagggccacctccttctgccacttgcaagagatgcaagaagggtaataacgatgtacacactttttttctcaataaatggcatctttttatttatacaagctctctggggtattcatttcccaccaccacccgccgttgtcgccatctggctctatttagaaatcgaaagggttctgccgggagtcgccgtgcgccacgggcagggacacgttgcgatactggtagcgggtgccccacttgaactcgggcaccaccaggcgaggcagctcggggaagttttcgctccacaggctgcgggtcagcaccagcgcgttcatcaggtcgggcgccgagatcttgaagtcgcagttggggccgccgccctgcgcgcgcgagttgcggtacaccgggttgcagcactggaacaccaacagcgccgggtgcttcacgctggccagcacgctgcggtcggagatcagctcggcgtccaggtcctccgcgttgctcagcgcgaacggggtcatcttgggcacttgccgccccaggaagggcgcgtgccccggtttcgagttgcagtcgcagcgcagcgggatcagcaggtgcccgtgcccggactcggcgttggggtacagcgcgcgcatgaaggcctgcatctggcggaaggccatctgggccttggcgccctccgagaagaacatgccgcaggacttgcccgagaactggtttgcggggcagctggcgtcgtgcaggcagcagcgcgcgtcggtgttggcgatctgcaccacgttgcgcccccaccggttcttcacgatcttggccttggacgattgctccttcagcgcgcgctgcccgttctcgctggtcacatccatctcgatcacatgttccttgttcaccatgctgctgccgtgcagacacttcagctcgccctccgtctcggtgcagcggtgctgccacagcgcgcagcccgtgggctcgaaagacttgtaggtcacctccgcgaaggactgcaggtacccctgcaaaaagcggcccatcatggtcacgaaggtcttgttgctgctgaaggtcagctgcagcccgcggtgctcctcgttcagccaggtcttgcacacggccgccagcgcctccacctggtcgggcagcatcttgaagttcaccttcagctcattctccacgtggtacttgtccatcagcgtgcgcgccgcctccatgcccttctcccaggccgacaccagcggcaggctcacggggttcttcaccatcaccgtggccgccgcctccgccgcgctttcgctttccgccccgctgttctcttcctcttcctcctcttcctcgccgccgcccactcgcagcccccgcaccacggggtcgtcttcctgcaggcgctgcaccttgcgcttgccgttgcgcccctgcttgatgcgcacgggcgggttgctgaagcccaccatcaccagcgcggcctcttcttgctcgtcctcgctgtccagaatgacctccggggagggggggttggtcatcctcagtaccgaggcacgcttctttttcttcctgggggcgttcgccagctccgcggctgcggccgctgccgaggtcgaaggccgagggctgggcgtgcgcggcaccagcgcgtcctgcgagccgtcctcgtcctcctcggactcgagacggaggcgggcccgcttcttcgggggcgcgcggggcggcggaggcggcggcggcgacggagacggggacgagacatcgtccagggtgggtggacggcgggccgcgccgcgtccgcgctcgggggtggtctcgcgctggtcctcttcccgactggccatctcccactgctccttctcctataggcagaaagagatcatggagtctctcatgcgagtcgagaaggaggaggacagcctaaccgccccctctgagccctccaccaccgccgccaccaccgccaatgccgccgcggacgacgcgcccaccgagaccaccgccagtaccaccctccccagcgacgcacccccgctcgagaatgaagtgctgatcgagcaggacccgggttttgtgagcggagaggaggatgaggtggatgagaaggagaaggaggaggtcgccgcctcagtgccaaaagaggataaaaagcaagaccaggacgacgcagataaggatgagacagcagtcgggcgggggaacggaagccatgatgctgatgacggctacctagacgtgggagacgacgtgctgcttaagcacctgcaccgccagtgcgtcatcgtctgcgacgcgctgcaggagcgctgcgaagtgcccctggacgtggcggaggtcagccgcgcctacgagcggcacctcttcgcgccgcacgtgccccccaagcgccgggagaacggcacctgcgagcccaacccgcgtctcaacttctacccggtcttcgcggtacccgaggtgctggccacctaccacatctttttccaaaactgcaagatccccctctcctgccgcgccaaccgcacccgcgccgacaaaaccctgaccctgcggcagggcgcccacatacctgatatcgcctctctggaggaagtgcccaagatcttcgagggtctcggtcgcgacgagaaacgggcggcgaacgctctgcacggagacagcgaaaacgagagtcactcgggggtgctggtggagctcgagggcgacaacgcgcgcctggccgtactcaagcgcagcatagaggtcacccactttgcctacccggcgctcaacctgccccccaaggtcatgagtgtggtcatgggcgagctcatcatgcgccgcgcccagcccctggccgcggatgcaaacttgcaagagtcctccgaggaaggcctgcccgcggtcagcgacgagcagctggcgcgctggctggagacccgcgaccccgcgcagctggaggagcggcgcaagctcatgatggccgcggtgctggtcaccgtggagctcgagtgtctgcagcgcttcttcgcggaccccgagatgcagcgcaagctcgaggagaccctgcactacaccttccgccagggctacgtgcgccaggcctgcaagatctccaacgtggagctctgcaacctggtctcctacctgggcatcctgcacgagaaccgcctcgggcagaacgtcctgcactccaccctcaaaggggaggcgcgccgcgactacatccgcgactgcgcctacctcttcctctgctacacctggcagacggccatgggggtctggcagcagtgcctggaggagcgcaacctcaaggagctggaaaagctcctcaagcgcaccctcagggacctctggacgggcttcaacgagcgctcggtggccgccgcgctggcggacatcatctttcccgagcgcctgctcaagaccctgcagcagggcctgcccgacttcaccagccagagcatgctgcagaacttcaggactttcatcctggagcgctcgggcatcctgccggccacttgctgcgcgctgcccagcgacttcgtgcccatcaagtacagggagtgcccgccgccgctctggggccactgctacctcttccagctggccaactacctcgcctaccactcggacctcatggaagacgtgagcggcgagggcctgctcgagtgccactgccgctgcaacctctgcacgccccaccgctctctagtctgcaacccgcagctgctcagcgagagtcagattatcggtaccttcgagctgcagggtccctcgcctgacgagaagtccgcggctccagggctgaaactcactccggggctgtggacttccgcctacctacgcaaatttgtacctgaggactaccacgcccacgagatcaggttctacgaagaccaatcccgcccgcccaaggcggagctcaccgcctgcgtcatcacccaggggcacatcctgggccaattgcaagccatcaacaaagcccgccgagagttcttgctgaaaaagggtcggggggtgtacctggacccccagtccggcgaggagctaaacccgctacccccgccgccgccccagcagcgggaccttgcttcccaggatggcacccagaaagaagcagcagccgccgccgccgccgcagccatacatgcttctggaggaagaggaggaggactgggacagtcaggcagaggaggtttcggacgaggagcaggaggagatgatggaagactgggaggaggacagcagcctagacgaggaagcttcagaggccgaagaggtggcagacgcaacaccatcgccctcggtcgcagccccctcgccggggcccctgaaatcctccgaacccagcaccagcgctataacctccgctcctccggcgccggcgccacccgcccgcagacccaaccgtagatgggacaccacaggaaccggggtcggtaagtccaagtgcccgccgccgccaccgcagcagcagcagcagcagcgccagggctaccgctcgtggcgcgggcacaagaacgccatagtcgcctgcttgcaagactgcgggggcaacatctctttcgcccgccgcttcctgctattccaccacggggtcgcctttccccgcaatgtcctgcattactaccgtcatctctacagcccctactgcagcggcgacccagaggcggcagcggcagccacagcggcgaccaccacctaggaagatatcctccgcgggcaagacagcggcagcagcggccaggagacccgcggcagcagcggcgggagcggtgggcgcactgcgcctctcgcccaacgaacccctctcgacccgggagctcagacacaggatcttccccactttgtatgccatcttccaacagagcagaggccaggagcaggagctgaaaataaaaaacagatctctgcgctccctcacccgcagctgtctgtatcacaaaagcgaagatcagcttcggcgcacgctggaggacgcggaggcactcttcagcaaatactgcgcgctcactcttaaagactagctccgcgcccttctcgaatttaggcgggagaaaactacgtcatcgccggccgccgcccagcccgcccagccgagatgagcaaagagattcccacgccatacatgtggagctaccagccgcagatgggactcgcggcgggagcggcccaggactactccacccgcatgaactacatgagcgcgggaccccacatgatctcacaggtcaacgggatccgcgcccagcgaaaccaaatactgctggaacaggcggccatcaccgccacgccccgccataatctcaacccccgaaattggcccgccgccctcgtgtaccaggaaaccccctccgccaccaccgtactacttccgcgtgacgcccaggccgaagtccagatgactaactcaggggcgcagctcgcgggcggctttcgtcacggggcgcggccgctccgaccaggtataagacacctgatgatcagaggccgaggtatccagctcaacgacgagtcggtgagctcttcgctcggtctccgtccggacggaactttccagctcgccggatccggccgctcttcgttcacgccccgccaggcgtacctgactctgcagacctcgtcctcggagccccgctccggcggcatcggaaccctccagttcgtggaggagttcgtgccctcggtctacttcaaccccttctcgggacctcccggacgctaccccgaccagttcattccgaactttgacgcggtgaaggactcggcggacggctacgactgaatgtcaggtgtcgaggcagagcagcttcgcctgagacacctcgagcactgccgccgccacaagtgcttcgcccgcggttctggtgagttctgctactttcagctacccgaggagcataccgaggggccggcgcacggcgtccgcctgaccacccagggcgaggttacctgttccctcatccgggagtttaccctccgtcccctgctagtggagcgggagcggggtccctgtgtcctaactatcgcctgcaactgccctaaccctggattacatcaagatctttgctgtcatctctgtgctgagtttaataaacgctgagatcagaatctactggggctcctgtcgccatcctgtgaacgccaccgtcttcacccaccccgaccaggcccaggcgaacctcacctgcggtctgcatcggagggccaagaagtacctcacctggtacttcaacggcaccccctttgtggtttacaacagcttcgacggggacggagtctccctgaaagaccagctctccggtctcagctactccatccacaagaacaccaccctccaactcttccctccctacctgccgggaacctacgagtgcgtcaccggccgctgcacccacctcacccgcctgatcgtaaaccagagctttccgggaacagataactccctcttccccagaacaggaggtgagctcaggaaactccccggggaccagggcggagacgtaccttcgacccttgtggggttaggattttttattaccgggttgctggctcttttaatcaaagtttccttgagatttgttctttccttctacgtgtatgaacacctcaacctccaataactctaccctttcttcggaatcaggtgacttctctgaaatcgggcttggtgtgctgcttactctgttgatttttttccttatcatactcagccttctgtgcctcaggctcgccgcctgctgcgcacacatctatatctactgctggttgctcaagtgcaggggtcgccacccaagatgaacaggtacatggtcctatcgatcctaggcctgctggccctggcggcctgcagcgccgccaaaaaagagattacctttgaggagcccgcttgcaatgtaactttcaagcccgagggtgaccaatgcaccaccctcgtcaaatgcgttaccaatcatgagaggctgcgcatcgactacaaaaacaaaactggccagtttgcggtctatagtgtgtttacgcccggagacccctctaactactctgtcaccgtcttccagggcggacagtctaagatattcaattacactttccctttttatgagttatgcgatgcggtcatgtacatgtcaaaacagtacaacctgtggcctccctctccccaggcgtgtgtggaaaatactgggtcttactgctgtatggctttcgcaatcactacgctcgctctaatctgcacggtgctatacataaaattcaggcagaggcgaatctttatcgatgaaaagaaaatgccttgatcgctaacaccggctttctatctgcagaatgaatgcaatcacctccctactaatcaccaccaccctccttgcgattgcccatgggttgacacgaatcgaagtgccagtggggtccaatgtcaccatggtgggccccgccggcaattccaccctcatgtgggaaaaatttgtccgcaatcaatgggttcatttctgctctaaccgaatcagtatcaagcccagagccatctgcgatgggcaaaatctaactctgatcaatgtgcaaatgatggatgctgggtactattacgggcagcggggagaaatcattaattactggcgaccccacaaggactacatgctgcatgtagtcgaggcacttcccactaccacccccactaccacctctcccaccaccaccaccactactactactactactactactactactactaccactaccgctgcccgccatacccgcaaaagcaccatgattagcacaaagccccctcgtgctcactcccacgccggcgggcccatcggtgcgacctcagaaaccaccgagctttgcttctgccaatgcactaacgccagcgctcatgaactgttcgacctggagaatgaggatgtccagcagagctccgcttgcctgacccaggaggctgtggagcccgttgccctgaagcagatcggtgattcaataattgactcttcttcttttgccactcccgaataccctcccgattctactttccacatcacgggtaccaaagaccctaacctctctttctacctgatgctgctgctctgtatctctgtggtctcttccgcgctgatgttactggggatgttctgctgcctgatctgccgcagaaagagaaaagctcgctctcagggccaaccactgatgcccttcccctaccccccggattttgcagataacaagatatgagctcgctgctgacactaaccgctttactagcctgcgctctaacccttgtcgcttgcgactcgagattccacaatgtcacagctgtggcaggagaaaatgttactttcaactccacggccgatacccagtggtcgtggagtggctcaggtagctacttaactatctgcaatagctccacttcccccggcatatccccaaccaagtaccaatgcaatgccagcctgttcaccctcatcaacgcttccaccctggacaatggactctatgtaggctatgtaccctttggtgggcaaggaaagacccacgcttacaacctggaagttcgccagcccagaaccactacccaagcttctcccaccaccaccaccaccaccaccatcaccagcagcagcagcagcagcagccacagcagcagcagcagattattgactttggttttggccagctcatctgccgctacccaggccatctacagctctgtgcccgaaaccactcagatccaccgcccagaaacgaccaccgccaccaccctacacacctccagcgatcagatgccgaccaacatcacccccttggctcttcaaatgggacttacaagccccactccaaaaccagtggatgcggccgaggtctccgccctcgtcaatgactgggcggggctgggaatgtggtggttcgccataggcatgatggcgctctgcctgcttctgctctggctcatctgctgcctccaccgcaggcgagccagaccccccatctatagacccatcattgtcctgaaccccgataatgatgggatccatagattggatggcctgaaaaacctacttttttcttttacagtatgataaattgagacatgcctcgcattttcttgtacatgttccttctcccaccttttctggggtgttctacgctggccgctgtgtctcacctggaggtagactgcctctcacccttcactgtctacctgctttacggattggtcaccctcactctcatctgcagcctaatcacagtaatcatcgccttcatccagtgcattgattacatctgtgtgcgcctcgcatacttcagacaccacccgcagtaccgagacaggaacattgcccaacttctaagactgctctaatcatgcataagactgtgatctgccttctgatcctctgcatcctgcccaccctcacctcctgccagtacaccacaaaatctccgcgcaaaagacatgcctcctgccgcttcacccaactgtggaatatacccaaatgctacaacgaaaagagcgagctctccgaagcttggctgtatggggtcatctgtgtcttagttttctgcagcactgtctttgccctcataatctacccctactttgatttgggatggaacgcgatcgatgccatgaattaccccacctttcccgcacccgagataattccactgcgacaagttgtacccgttgtcgttaatcaacgccccccatcccctacgcccactgaaatcagctactttaacctaacaggcggagatgactgacgccctagatctagaaatggacggcatcagtaccgagcagcgtctcctagagaggcgcaggcaggcggctgagcaagagcgcctcaatcaggagctccgagatctcgttaacctgcaccagtgcaaaagaggcatcttttgtctggtaaagcaggccaaagtcacctacgagaagaccggcaacagccaccgcctcagttacaaattgcccacccagcgccagaagctggtgctcatggtgggtgagaatcccatcaccgtcacccagcactcggtagagaccgaggggtgtctgcactccccctgtcggggtccagaagacctctgcaccctggtaaagaccctgtgcggtctcagagatttagtcccctttaactaatcaaacactggaatcaataaaaagaatcacttacttaaaatcagacagcaggtctctgtccagtttattcagcagcacctccttcccctcctcccaactctggtactccaaacgccttctggcggcaaacttcctccacaccctgaagggaatgtcagattcttgctcctgtccctccgcacccactatcttcatgttgttgcagatgaagcgcaccaaaacgtctgacgagagcttcaaccccgtgtacccctatgacacggaaagcggccctccctccgtccctttcctcacccctcccttcgtgtctcccgatggattccaagaaagtccccccggggtcctgtctctgaacctggccgagcccctggtcacttcccacggcatgctcgccctgaaaatgggaagtggcctctccctggacgacgctggcaacctcacctctcaagatatcaccaccgctagccctcccctcaaaaaaaccaagaccaacctcagcctagaaacctcatcccccctaactgtgagcacctcaggcgccctcaccgtagcagccgccgctcccctggcggtggccggcacctccctcaccatgcaatcagaggcccccctgacagtacaggatgcaaaactcaccctggccaccaaaggccccctgaccgtgtctgaaggcaaactggccttgcaaacatcggccccgctgacggccgctgacagcagcaccctcacagtcagtgccacaccaccccttagcacaagcaatggcagcttgggtattgacatgcaagcccccatttacaccaccaatggaaaactaggacttaactttggcgctcccctgcatgtggtagacagcctaaatgcactgactgtagttactggccaaggtcttacgataaacggaacagccctacaaactagagtctcaggtgccctcaactatgacacatcaggaaacctagaattgagagctgcagggggtatgcgagttgatgcaaatggtcaacttatccttgatgtagcttacccatttgatgcacaaaacaatctcagccttaggcttggacagggacccctgtttgttaactctgcccacaacttggatgttaactacaacagaggcctctacctgttcacatctggaaataccaaaaagctagaagttaatatcaaaacagccaagggtctcatttatgatgacactgctatagcaatcaatgcgggtgatgggctacagtttgactcaggctcagatacaaatccattaaaaactaaacttggattaggactggattatgactccagcagagccataattgctaaactgggaactggcctaagctttgacaacacaggtgccatcacagtaggcaacaaaaatgatgacaagcttaccttgtggaccacaccagacccatcccctaactgtagaatctattcagagaaagatgctaaattcacacttgttttgactaaatgcggcagtcaggtgttggccagcgtttctgttttatctgtaaaaggtagccttgcgcccatcagtggcacagtaactagtgctcagattgtcctcagatttgatgaaaatggagttctactaagcaattcttcccttgaccctcaatactggaactacagaaaaggtgaccttacagagggcactgcatataccaacgcagtgggatttatgcccaacctcacagcatacccaaaaacacagagccaaactgctaaaagcaacattgtaagtcaggtttacttgaatggggacaaatccaaacccatgaccctcaccattaccctcaatggaactaatgaaacaggagatgccacagtaagcacttactccatgtcattctcatggaactggaatggaagtaattacattaatgaaacgttccaaaccaactccttcaccttctcctacatcgcccaagaataaaaagcatgacgctgttgatttgattcaatgtgtttctgttttattttcaagcacaacaaaatcattcaagtcattcttccatcttagcttaatagacacagtagcttaatagacccagtagtgcaaagccccattctagcttatagatcagacagtgataattaaccaccaccaccaccataccttttgattcaggaaatcatgatcatcacaggatcctagtcttcaggccgccccctccctcccaagacacagaatacacagtcctctccccccgactggctttaaataacaccatctggttggtcacagacatgttcttaggggttatattccacacggtctcctgccgcgccaggcgctcgtcggtgatgttgataaactctcccggcagctcgctcaagttcacgtcgctgtccagcggctgaacctccggctgacgcgataactgtgcgaccggctgctggacgaacggaggccgcgcctacaagggggtagagtcataatcctcggtcaggatagggcggtgatgcagcagcagcgagcgaaacatctgctgccgccgccgctccgtccggcaggaaaacaacacgccggtggtctcctccgcgataatccgcaccgcccgcagcatcagcttcctcgttctccgcgcgcagcacctcacccttatctcgctcaaatcggcgcagtaggtacagcacagcaccacgatgttattcatgatcccacagtgcagggcgctgtatccaaagctcatgccgggaaccaccgcccccacgtggccatcgtaccacaagcgcacgtaaatcaagtgtcgacccctcatgaacgcgctggacacaaacattacttccttgggcatgttgtaattcaccacctcccggtaccagataaacctctggttgaacagggcaccttccaccaccatcctgaaccaagaggccagaacctgcccaccggctatgcactgcagggaacccgggttggaacaatgacaatgcagactccaaggctcgtaaccgtggatcatccggctgctgaaggcatcgatgttggcacaacacagacacacgtgcatgcactttctcatgattagcagctcttccctcgtcaggatcatatcccaaggaataacccattcttgaatcaacgtaaaacccacacagcagggaaggcctcgcacataactcacgttgtgcatggtcagcgtgttgcattccggaaacagcggatgatcctccagtatcgaggcgcgggtctccttctcacagggaggtaaagggtccctgctgtacggactgcgccgggacgaccgagatcgtgttgagcgtagtgtcatggaaaagggaacgccggacgtggtcatacttcttgaagcagaaccaggttcgcgcgtggcaggcctccttgcgtctgcggtctcgccgtctagctcgctccgtgtgatagttgtagtacagccactcccgcagagcgtcgaggcgcaccctggcttccggatctatgtagactccgtcttgcaccgcggccctgataatatccaccaccgtagaataagcaacacccagccaagcaatacactcgctctgcgagcggcagacaggaggagcgggcagagatgggagaaccatgataaaaaactttttttaaagaatattttccaattcttcgaaagtaagatctatcaagtggcagcgctcccctccactggcgcggtcaaactctacggccaaagcacagacaacggcatttctaagatgttccttaatggcgtccaaaagacacaccgctctcaagttgcagtaaactatgaatgaaaacccatccggctgattttccaatatagacgcgccggcagcgtccaccaaacccagataattttcttctctccagcggtttacgatctgtctaagcaaatcccttatatcaagtccgaccatgccaaaaatctgctcaagagcgccctccaccttcatgtacaagcagcgcatcatgattgcaaaaattcaggttcttcagagacctgtataagattcaaaatgggaacattaacaaaaattcctctgtcgcgcagatcccttcgcagggcaagctgaacataatcagacaggtccgaacggaccagtgaggccaaatccccaccaggaaccagatccagagaccctatactgattatgacgcgcatactcggggctatgctgaccagcgtagcgccgatgtaggcgtgctgcatgggcggcgagataaaatgcaaagtgctggttaaaaaatcaggcaaagcctcgcgcaaaaaagctaacacatcataatcatgctcatgcaggtagttgcaggtaagctcaggaaccaaaacggaataacacacgattttcctctcaaacatgacttcgcggatactgcgtaaaacaaaaaattataaataaaaaattaattaaataacttaaacattggaagcctgtctcacaacaggaaaaaccactttaatcaacataagacgggccacgggcatgccggcatagccgtaaaaaaattggtccccgtgattaacaagtaccacagacagctccccggtcatgtcgggggtcatcatgtgagactctgtatacacgtctggattgtgaacatcagacaaacaaagaaatcgagccacgtagcccggaggtataatcacccgcaggcggaggtacagcaaaacgacccccataggaggaatcacaaaattagtaggagaaaaaaatacataaacaccagaaaaaccctgttgctgaggcaaaatagcgccctcccgatccaaaacaacataaagcgcttccacaggagcagccataacaaagacccgagtcttaccagtaaaagaaaaaagatctctcaacgcagcaccagcaccaacacttcgcagtgtaaaaggccaagtgccgagagagtatatataggaataaaaagtgacgtaaacgggcaaagtccaaaaaacgcccagaaaaaccgcacgcgaacctacgccccgaaacgaaagccaaaaaacactagacactcccttccggcgtcaacttccgctttcccacgctacgtcacttgccccagtcaaacaaactacatatcccgaacttccaagtcgccacgcccaaaacaccgcctacacctccccgcccgccggcccgcccccaaacccgcctcccgccccgcgccccgccccgcgccgcccatctcattatcatattggcttcaatccaaaataaggtatattattgatgatggtttaaacggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgatgcggccgcaaggggttcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcctcgtttaaac

SEQ ID NO: 10 - DNA, 37830 bp, Simian adenovirus
catcatcaataatataccttattttggattgaagccaatatgataatgagatgggcggcgcggggcgggaggcgggtccgggggcgggccggcgggcggggcggtgtggcggaagtggactttgtaagtgtggcggatgtgacttgctagtgccgggcgcggtaaaagtgacgttttccgtgcgcgacaacgcccacgggaagtgacatttttcccgcggtttttaccggatgttgtagtgaatttgggcgtaaccaagtaagatttggccattttcgcgggaaaactgaaacggggaagtgaaatctgattaatttcgcgttagtcataccgcgtaatatttgtcgagggccgagggactttggccgattacgtggaggactcgcccaggtgttttttgaggtgaatttccgcgttccgggtcaaagtctccgttttattattatagtcagctgacgcggagtgtatttataccctctgatctcgtcaagtggccactcttgagtgccagcgagtagagttttctcctctgccgctctccgctccgctccgctcggctctgacaccggggaaaaaatgagacatttcacctacgatggcggtgtgctcaccggccagctggctgctgaagtcctggacaccctgatcgaggaggtattggccgataattatcctccctcgactccttttgagccacctacacttcacgaactctacgatctggatgtggtggggcccagcgatccgaacgagcaggcggtttccagtttttttccagagtccatgttgttggccagccaggagggggtcgaacttgagacccctcctccgatcgtggattcccccgatccgccgcagctgactaggcagcccgagcgctgtgcgggacctgagactatgccccagctgctacctgaggtgatcgatctcacctgtaatgagtctggttttccacccagcgaggatgaggacgaagagggtgagcagtttgtgttagattctgtggaacaacccgggcgaggatgcaggtcttgtcaatatcaccggaaaaacacaggagactcccagattatgtgttctctgtgttatatgaagatgacctgtatgtttatttacagtaagtttatcatctgtgggcaggtgggctatagtgtgggtggtggtctttggggggttttttaatatatgtcaggggttatgctgaagacttttttattgtgatttttaaaggtccagtgtctgagcccgagcaagaacctgaaccggagcctgagccttctcgccccaggagaaagcctgtaatcttaactagacccagcgcaccggtagcgagaggcctcagcagcgcggagaccaccgactccggtgcttcctcatcacccccggagattcaccccctggtgcccctgtgtcccgttaagcccgttgccgtgagagtcagtgggcggcggtctgctgtggagtgcattgaggacttgctttttgattcacaggaacctttggacttgagcttgaaacgccccaggcattaaacctggtcacctggactgaatgagttgacgcctatgtttgcttttgaatgacttaatgtgtatagataataaagagtgagataatgttttaattgcatggtgtgtttaacttgggcggagtctgctgggtatataagcttccctgggctaaacttggttacacttgacctcatggaggcctgggagtgtttggagaactttgccggagttcgtgccttgctggacgagagctctaacaatacctcttggtggtggaggtatttgtggggctctccccagggcaagttagtttgtagaatcaaggaggattacaagtgggaatttgaagagcttttgaaatcctgtggtgagctattggattctttgaatctaggccaccaggctctcttccaggagaaggtcatcaggactttggatttttccacaccggggcgcattgcagccgcggttgcttttctagcttttttgaaggatagatggagcgaagagacccacttgagttcgggctacgtcctggattttctggccatgcaactgtggagagcatggatcagacacaagaacaggctgcaactgttgtcttccgtccgcccgttgctgattccggcggaggagcaacaggccgggtcagaggaccgggcccgtcgggatccggaggagagggcaccgaggccgggcgagaggagcgcgctgaacctgggaaccgggctgagcggccatccacatcgggagtgaatgtcgggcaggtggtggatctttttccagaactgcggcggattttgactattagggaggatgggcaatttgttaagggtcttaagagggagaggggggcttctgagcataacgaggaggccagtaatttagcttttagcttgatgaccagacaccgtccagagtgcatcacttttcagcagattaaggacaattgtgccaatgagttggatctgttgggtcagaagtatagcatagagcagctgaccacttactggctgcagccgggtgatgatctggaggaagctattagggtgtatgctaaggtggccctgcggcccgattgcaagtacaagctcaaggggctggtgaatatcaggaattgttgctacatttctggcaacggggcggaggtggagatagagaccgaagacagggtggctttcagatgcagcatgatgaatatgtggccgggggtgctgggcatggacggggtggtgattatgaatgtgaggttcacggggcccaactttaacggcacggtgtttttggggaacaccaacctggtcctgcacggggtgagcttctatgggtttaacaacacctgtgtggaggcctggaccgatgtgaaggtccgcggttgcgccttttatggatgttggaaggccatagtgagccgccctaagagcaggagttccattaagaaatgcttgtttgagaggtgcaccttggggatcctggccgagggcaactgcagggtgcgccacaatgtggcctccgagtgcggttgcttcatgctagtcaagagcgtggcggtaatcaagcataatatggtgtgcggcaacagcgaggacaaggcctcacagatgctgacctgcacggatggcaactgccacttgctgaagaccatccatgtaaccagccacagccggaaggcctggcccgtgttcgagcacaacttgctgacccgctgctccttgcatctgggcaacaggcggggggtgttcctgccctatcaatgcaactttagtcacaccaagatcttgctagagcccgagagcatgtccaaggtgaacttgaacggggtgtttgacatgaccatgaagatctggaaggtgctgaggtacgacgagaccaggtcccggtgcagaccctgcgagtgcgggggcaagcatatgaggaaccagcccgtgatgctggatgtgaccgaggagctgaggacagaccacttggttctggcctgcaccagggccgagtttggttctagcgatgaagacacagattgaggtgggtgagtgggcgtggcctggggtggtcatgaaaatatataagttgggggtcttagggtctctttatttgtgttgcagagaccgccggagccatgagcgggagcagcagcagcagcagtagcagcagcgccttggatggcagcatcgtgagcccttatttgacgacgcggatgccccactgggccggggtgcgtcagaatgtgatgggctccagcatcgacggccgacccgtcctgcccgcaaattccgccacgctgacctatgcgaccgtcgcggggacgccgttggacgccaccgccgccgccgccgccaccgcagccgcctcggccgtgcgcagcctggccacggactttgcattcctgggaccactggcgacaggggctacttctcgggccgctgctgccgccgttcgcgatgacaagctgaccgccctgctggcgcagttggatgcgcttactcgggaactgggtgacctttctcagcaggtcatggccctgcgccagcaggtctcctccctgcaagctggcgggaatgcttctcccacaaatgccgtttaagataaataaaaccagactctgtttggattaaagaaaagtagcaagtgcattgctctctttatttcataattttccgcgcgcgataggccctagaccagcgttctcggtcgttgagggtgcggtgtatcttctccaggacgtggtagaggtggctctggacgttgagatacatgggcatgagcccgtcccgggggtggaggtagcaccactgcagagcttcatgctccggggtggtgttgtagatgatccagtcgtagcaggagcgctgggcatggtgcctaaaaatgtccttcagcagcaggccgatggccagggggaggcccttggtgtaagtgtttacaaaacggttaagttgggaagggtgcattcggggagagatgatgtgcatcttggactgtatttttagattggcgatgtttccgcccagatcccttctgggattcatgttgtgcaggaccaccagtacagtgtatccggtgcacttggggaatttgtcatgcagcttagagggaaaagcgtggaagaacttggagacgcctttgtggcctcccagattttccatgcattcgtccatgatgatggcaatgggcccgcgggaggcagcttgggcaaagatatttctggggtcgctgacgtcgtagttgtgttccagggtgaggtcgtcataggccatttttacaaagcgcgggcggagggtgcccgactgggggatgatggtcccctctggccctggggcgtagttgccctcgcagatctgcatttcccaggccttaatctcggaggggggaatcatatccacctgcggggcgatgaagaaaacggtttccggagccggggagattaactgggatgagagcaggtttctaagcagctgtgattttccacaaccggtgggcccataaataacacctataaccggttgcagctggtagtttagagagctgcagctgccgtcgtcccggaggaggggggccacctcgttgagcatgtccctgacgcgcatgttctccccgaccagatccgccagaaggcgctcgccgcccagggacagcagctcttgcaaggaagcaaagtttttcagcggcttgaggccgtccgccgtgggcatgtttttcagggtctggctcagcagctccaggcggtcccagagctcggtgacgtgctctacggcatctctatccagcatatctcctcgtttcgcgggttggggcgactttcgctgtagggcaccaagcggtggtcgtccagcggggccagagtcatgtccttccatgggcgcagggtcctcgtcagggtggtctgggtcacggtgaaggggtgcgctccgggctgagcgcttgccaaggtgcgcttgaggctggttctgctggtgctgaagcgctgccggtcttcgccctgcgcgtcggccaggtagcatttgaccatggtgtcatagtccagcccctccgcggcgtgtcccttggcgcgcagcttgcccttggaggtggcgccgcacgaggggcagagcaggctcttgagcgcgtagagcttgggggcgaggaagaccgattcgggggagtaggcgtccgcgccgcagaccccgcacacggtctcgcactccaccagccaggtgagctcggggcgcgccgggtcaaaaaccaggtttcccccatgctttttgatgcgtttcttacctcgggtctccatgaggtggtgtccccgctcggtgacgaagaggctgtccgtgtctccgtagaccgacttgaggggtcttttctccaggggggtccctcggtcttcctcgtagaggaactcggaccactctgagacgaaggcccgcgtccaggccaggacgaaggaggctatgtgggaggggtagcggtcgttgtccactagggggtccaccttctccaaggtgtgaagacacatgtcgccttcctcggcgtccaggaaggtgattggcttgtaggtgtaggccacgtgaccgggggttcctgacgggggggtataaaagggggtgggggcgcgctcgtcgtcactctcttccgcatcgctgtctgcgagggccagctgctggggtgagtattccctctcgaaggcgggcatgacctccgcgctgaggttgtcagtttccaaaaacgaggaggatttgatgttcacctgtcccgaggtgatacctttgagggtacccgcgtccatctggtcagaaaacacgatctttttattgtccagcttggtggcgaacgacccgtagagggcgttggagagcagcttggcgatggagcgcagggtctggttcttgtccctgtcggcgcgctccttggccgcgatgttgagctgcacgtactcgcgcgcgacgcagcgccactcggggaagacggtggtgcgctcgtcgggcaccaggcgcacgcgccagccgcggttgtgcagggtgaccaggtccacgctggtggcgacctcgccgcgcaggcgctcgttggtccagcagagacggccgcccttgcgcgagcagaaggggggcagggggtcgagctgggtctcgtccggggggtccgcgtccacggtgaaaaccccggggcgcaggcgcgcgtcgaagtagtctatcttgcaaccttgcatgtccagcgcctgctgccagtcgcgggcggcgagcgcgcgctcgtaggggttgagcggcgggccccagggcatggggtgggtgagtgcggaggcgtacatgccgcagatgtcatagacgtagaggggctcccgcaggaccccgatgtaggtggggtagcagcggccgccgcggatgctggcgcgcacgtagtcatacagctcgtgcgagggggcgaggaggtcggggcccaggttggtgcgggcggggcgctccgcgcggaagacgatctgcctgaagatggcatgcgagttggaagagatggtggggcgctggaagacgttgaagctggcgtcctgcaggccgacggcgtcgcgcacgaaggaggcgtaggagtcgcgcagcttgtgtaccagctcggcggtgacctgcacgtcgagcgcgcagtagtcgagggtctcgcggatgatgtcatatttagcctgccccttctttttccacagctcgcggttgaggacaaactcttcgcggtctttccagtactcttggatcgggaaaccgtccggttccgaacggtaagagcctagcatgtagaactggttgacggcctggtaggcgcagcagcccttctccacggggagggcgtaggcctgcgcggccttgcggagcgaggtgtgggtcagggcgaaggtgtccctgaccatgactttgaggtactggtgcttgaagtcggagtcgtcgcagccgccccgctcccagagcgagaagtcggtgcgcttcttggagcgggggttgggcagagcgaaggtgacatcgttgaagaggattttgcccgcgcggggcatgaagttgcgggtgatgcggaagggccccggcacttcagagcggttgttgatgacctgggcggcgagcacgatctcgtcgaagccgttgatgttgtggcccacgatgtagagttccaggaagcggggccggccctttacggtgggcagcttctttagctcttcgtaggtgagctcctcgggcgaggcgaggccgtgctcggccagggcccagtccgcgaggtgcgggttgtctctgaggaaggacttccagaggtcgcgggccaggagggtctgcaggcggtctctgaaggtcctgaactggcggcccacggccattttttcgggggtgatgcagtagaaggtgagggggtcttgctgccagcggtcccagtcgagctgcagggcgaggtcgcgcgcggcggtgaccaggcgctcgtcgcccccgaatttcatgaccagcatgaagggcacgagctgctttccgaaggcccccatccaagtgtaggtctctacatcgtaggtgacaaagaggcgctccgtgcgaggatgcgagccgatcgggaagaactggatctcccgccaccagttggaggagtggctgttgatgtggtggaagtagaagtcccgtcgccgggccgaacactcgtgctggcttttgtaaaagcgagcgcagtactggcagcgctgcacgggctgtacctcatgcacgagatgcacctttcgcccgcgcacgaggaagccgaggggaaatctgagccccccgcctggctcgcggcatggctggttctcttctactttggatgcgtgtccgtctccgtctggctcctcgaggggtgttacggtggagcggaccaccacgccgcgcgagccgcaggtccagatatcggcgcgcggcggtcggagtttgatgacgacatcgcgcagctgggagctgtccatggtctggagctcccgcggcggcggcaggtcagccgggagttcttgcaggttcacctcgcagagtcgggccagggcgcggggcaggtctaggtggtacctgatctctaggggcgtgttggtggcggcgtcgatggcttgcaggagcccgcagccccggggggcgacgacggtgccccgcggggtggtggtggtggtggcggtgcagctcagaagcggtgccgcgggcgggcccccggaggtagggggggctccggtcccgcgggcaggggcggcagcggcacgtcggcgtggagcgcgggcaggagttggtgctgtgcccggaggttgctggcgaaggcgacgacgcggcggttgatctcctggatctggcgcctctgcgtgaagacgacgggcccggtgagcttgaacctgaaagagagttcgacagaatcaatctcggtgtcattgaccgcggcctggcgcaggatctcctgcacgtctcccgagttgtcttggtaggcgatctcggccatgaactgctcgatctcttcctcctggaggtctccgcgtccggcgcgttccacggtggccgccaggtcgttggagatgcgccccatgagctgcgagaaggcgttgagtccgccctcgttccagactcggctgtagaccacgcccccctggtcatcgcgggcgcgcatgaccacctgcgcgaggttgagctccacgtgccgcgcgaagacggcgtagttgcgcagacgctggaagaggtagttgagggtggtggcggtgtgctcggccacgaagaagttcatgacccagcggcgcaacgtggattcgttgatgtcccccaaggcctccagccgttccatggcctcgtagaagtccacggcgaagttgaaaaactgggagttgcgcgccgacacggtcaactcctcctccagaagacggatgagctcggcgacggtgtcgcgcacctcgcgctcgaaggctatggggatctcttcctccgctagcatcaccacctcctcctcttcctcctcttctggcacttccatgatggcttcctcctcttcggggggtggcggcggcggcggtgggggagggggcgctctgcgccggcggcggcgcaccgggaggcggtccacgaagcgcgcgatcatctccccgcggcggcggcgcatggtctcggtgacggcgcggccgttctcccgggggcgcagttggaagacgccgccggacatctggtgctggggcgggtggccgtgaggcagcgagacggcgctgacgatgcatctcaacaattgctgcgtaggtacgccgccgagggacctgagggagtccatatccaccggatccgaaaacctttcgaggaaggcgtctaaccagtcgcagtcgcaaggtaggctgagcaccgtggcgggcggcggggggtggggggagtgtctggcggaggtgctgctgatgatgtaattgaagtaggcggacttgacacggcggatggtcgacaggagcaccatgtccttgggtccggcctgctggatgcggaggcggtcggctatgccccaggcttcgttctggcatcggcgcaggtccttgtagtagtcttgcatgagcctttccaccggcacctcttctccttcctcttctgcttcttccatgtctgcttcggccctggggcggcgccgcgcccccctgccccccatgcgcgtgaccccgaaccccctgagcggttggagcagggccaggtcggcgacgacgcgctcggccaggatggcctgctgcacctgcgtgagggtggtttggaagtcatccaagtccacgaagcggtggtaggcgcccgtgttgatggtgtaggtgcagttggccatgacggaccagttgacggtctggtggcccggttgcgacatctcggtgtacctgagtcgcgagtaggcgcgggagtcgaagacgtagtcgttgcaagtccgcaccaggtactggtagcccaccaggaagtgcggcggcggctggcggtagaggggccagcgcagggtggcgggggctccgggggccaggtcttccagcatgaggcggtggtaggcgtagatgtacctggacatccaggtgatacccgcggcggtggtggaggcgcgcgggaagtcgcgcacccggttccagatgttgcgcaggggcagaaagtgctccatggtaggcgtgctctgtccagtcagacgcgcgcagtcgttgatactctagaccagggaaaacgaaagccggtcagcgggcactcttccgtggtctggtgaatagatcgcaagggtatcatggcggagggcctcggttcgagccccgggtccgggccggacggtccgccatgatccacgcggttaccgcccgcgtgtcgaacccaggtgtgcgacgtcagacaacggtggagtgttccttttggcgtttttctggccgggcgccggcgccgcgtaagagactaagccgcgaaagcgaaagcagtaagtggctcgctccccgtagccggagggatccttgctaagggttgcgttgcggcgaaccccggttcgaatcccgtactcgggccggccggacccgcggctaaggtgttggattggcctccccctcgtataaagaccccgcttgcggattgactccggacacggggacgagccccttttatttttgctttccccagatgcatccggtgctgcggcagatgcgccccccgccccagcagcagcaacaacaccagcaagagcggcagcaacagcagcgggagtcatgcagggccccctcacccaccctcggcgggccggccacctcggcgtccgcggccgtgtctggcgcctgcggcggcggcggggggccggctgacgaccccgaggagcccccgcggcgcagggccagacactacctggacctggaggagggcgagggcctggcgcggctgggggcgccgtctcccgagcgccacccgcgggtgcagctgaagcgcgactcgcgcgaggcgtacgtgcctcggcagaacctgttcagggaccgcgcgggcgaggagcccgaggagatgcgggacaggaggttcagcgcagggcgggagctgcggcaggggctgaaccgcgagcggctgctgcgcgaggaggactttgagcccgacgcgcggacggggatcagccccgcgcgcgcgcacgtggcggccgccgacctggtgacggcgtacgagcagacggtgaaccaggagatcaacttccaaaagagtttcaacaaccacgtgcgcacgctggtggcgcgcgaggaggtgaccatcgggctgatgcacctgtgggactttgtaagcgcgctggtgcagaaccccaacagcaagcctctgacggcgcagctgttcctgatagtgcagcacagcagggacaacgaggcgtttagggacgcgctgctgaacatcaccgagcccgagggtcggtggctgctggacctgattaacatcctgcagagcatagtggtgcaggagcgcagcctgagcctggccgacaaggtggcggccatcaactactcgatgctgagcctgggcaagttttacgcgcgcaagatctaccagacgccgtacgtgcccatagacaaggaggtgaagatcgacggtttttacatgcgcatggcgctgaaggtgctcaccctgagcgacgacctgggcgtgtaccgcaacgagcgcatccacaaggccgtgagcgtgagccggcggcgcgagctgagcgaccgcgagctgatgcacagcctgcagcgggcgctggcgggcgccggcagcggcgacagggaggcggagtcctacttcgatgcgggggcggacctgcgctgggcgcccagccggcgggccctggaggccgcgggggtccgcgaggactatgacgaggacggcgaggaggatgaggagtacgagctagaggagggcgagtacctggactaaaccgcgggtggtgtttccggtagatgcaagacccgaacgtggtggacccggcgctgcgggcggctctgcagagccagccgtccggccttaactcctcagacgactggcgacaggtcatggaccgcatcatgtcgctgacggcgcgtaacccggacgcgttccggcagcagccgcaggccaacaggctctccgccatcctggaggcggtggtgcctgcgcgctcgaaccccacgcacgagaaggtgctggccatagtgaacgcgctggccgagaacagggccatccgcccggacgaggccgggctggtgtacgacgcgctgctgcagcgcgtggcccgctacaacagcggcaacgtgcagaccaacctggaccggctggtgggggacgtgcgcgaggcggtggcgcagcgcgagcgcgcggatcggcagggcaacctgggctccatggtggcgctgaatgccttcctgagcacgcagccggccaacgtgccgcgggggcaggaagactacaccaactttgtgagcgcgctgcggctgatggtgaccgagaccccccagagcgaggtgtaccagtcgggcccggactacttcttccagaccagcagacagggcctgcagacggtgaacctgagccaggctttcaagaacctgcgggggctgtggggcgtgaaggcgcccaccggcgaccgggcgacggtgtccagcctgctgacgcccaactcgcgcctgctgctgctgctgatcgcgccgttcacggacagcggcagcgtgtcccgggacacctacctggggcacctgctgaccctgtaccgcgaggccatcgggcaggcgcaggtggacgagcacaccttccaggagatcaccagcgtgagccgcgcgctggggcaggaggacacgagcagcctggaggcgactctgaactacctgctgaccaaccggcggcagaagattccctcgctgcacagcctgacctccgaggaggagcgcatcttgcgctacgtgcagcagagcgtgagcctgaacctgatgcgcgacggggtgacgcccagcgtggcgctggacatgaccgcgcgcaacatggaaccgggcatgtacgccgcgcaccggccttacatcaaccgcctgatggactacctgcatcgcgcggcggccgtgaaccccgagtactttaccaacgccatcctgaacccgcactggctcccgccgcccgggttctacagcgggggcttcgaggtcccggagaccaacgatggcttcctgtgggacgacatggacgacagcgtgttctccccgcggccgcaggcgctggcggaagcgtccctgctgcgtcccaagaaggaggaggaggaggaggcgagtcgccgccgcggcagcagcggcgtggcttctctgtccgagctgggggcggcagccgccgcgcgccccgggtccctgggcggcagcccctttccgagcctggtggggtctctgcacagcgagcgcaccacccgccctcggctgctgggcgaggacgagtacctgaataactccctgctgcagccggtgcgggagaaaaacctgcctcccgccttccccaacaacgggatagagagcctggtggacaagatgagcagatggaagacctatgcgcaggagcacagggacgcgcctgcgctccggccgcccacgcggcgccagcgccacgaccggcagcgggggctggtgtgggatgacgaggactccgcggacgatagcagcgtgctggacctgggagggagcggcaacccgttcgcgcacctgcgcccccgcctggggaggatgttttaaaaaaaaaaaaaaaaagcaagaagcatgatgcaaaaattaaataaaactcaccaaggccatggcgaccgagcgttggtttcttgtgttcccttcagtatgcggcgcgcggcgatgtaccaggagggacctcctccctcttacgagagcgtggtgggcgcggcggcggcggcgccctcttctccctttgcgtcgcagctgctggagccgccgtacgtgcctccgcgctacctgcggcctacgggggggagaaacagcatccgttactcggagctggcgcccctgttcgacaccacccgggtgtacctggtggacaacaagtcggcggacgtggcctccctgaactaccagaacgaccacagcaattttttgaccacggtcatccagaacaatgactacagcccgagcgaggccagcacccagaccatcaatctggatgaccggtcgcactggggcggcgacctgaaaaccatcctgcacaccaacatgcccaacgtgaacgagttcatgttcaccaataagttcaaggcgcgggtgatggtgtcgcgctcgcacaccaaggaagaccgggtggagctgaagtacgagtgggtggagttcgagctgccagagggcaactactccgagaccatgaccattgacctgatgaacaacgcgatcgtggagcactatctgaaagtgggcaggcagaacggggtcctggagagcgacatcggggtcaagttcgacaccaggaacttccgcctggggctggaccccgtgaccgggctggttatgcccggggtgtacaccaacgaggccttccatcccgacatcatcctgctgcccggctgcggggtggacttcacttacagccgcctgagcaacctcctgggcatccgcaagcggcagcccttccaggagggcttcaggatcacctacgaggacctggaggggggcaacatccccgcgctcctcgatgtggaggcctaccaggatagcttgaaggaaaatgaggcgggacaggaggataccgcccccgccgcctccgccgccgccgagcagggcgaggatgctgctgacaccgcggccgcggacggggcagaggccgaccccgctatggtggtggaggctcccgagcaggaggaggacatgaatgacagtgcggtgcgcggagacaccttcgtcacccggggggaggaaaagcaagcggaggccgaggccgcggccgaggaaaagcaactggcggcagcagcggcggcggcggcgttggccgcggcggaggctgagtctgaggggaccaagcccgccaaggagcccgtgattaagcccctgaccgaagatagcaagaagcgcagttacaacctgctcaaggacagcaccaacaccgcgtaccgcagctggtacctggcctacaactacggcgacccgtcgacgggggtgcgctcctggaccctgctgtgcacgccggacgtgacctgcggctcggagcaggtgtactggtcgctgcccgacatgatgcaagaccccgtgaccttccgctccacgcggcaggtcagcaacttcccggtggtgggcgccgagctgctgcccgtgcactccaagagcttctacaacgaccaggccgtctactcccagctcatccgccagttcacctctctgacccacgtgttcaatcgctttcctgagaaccagattctggcgcgcccgcccgcccccaccatcaccaccgtcagtgaaaacgttcctgctctcacagatcacgggacgctaccgctgcgcaacagcatcggaggagtccagcgagtgaccgttactgacgccagacgccgcacctgcccctacgtttacaaggccttgggcatagtctcgccgcgcgtcctttccagccgcactttttgagcaacaccaccatcatgtccatcctgatctcacccagcaataactccggctggggactgctgcgcgcgcccagcaagatgttcggaggggcgaggaagcgttccgagcagcaccccgtgcgcgtgcgcgggcacttccgcgccccctggggagcgcacaaacgcggccgcgcggggcgcaccaccgtggacgacgccatcgactcggtggtggagcaggcgcgcaactacaggcccgcggtctctaccgtggacgcggccatccagaccgtggtgcggggcgcgcggcggtacgccaagctgaagagccgccggaagcgcgtggcccgccgccaccgccgccgacccggggccgccgccaaacgcgccgccgcggccctgcttcgccgggccaagcgcacgggccgccgcgccgccatgagggccgcgcgccgcttggccgccggcatcaccgccgccaccatggccccccgtacccgaagacgcgcggccgccgccgccgccgccgccatcagtgacatggccagcaggcgccggggcaacgtgtactgggtgcgcgactcggtgaccggcacgcgcgtgcccgtgcgcttccgccccccgcggacttgagatgatgtgaaaaaacaacactgagtctcctgctgttgtgtgtatcccagcggcggcggcgcgcgcagcgtcatgtccaagcgcaaaatcaaagaagagatgctccaggtcgtcgcgccggagatctatgggcccccgaagaaggaagagcaggattcgaagccccgcaagataaagcgggtcaaaaagaaaaagaaagatgatgacgatgccgatggggaggtggagttcctgcgcgccacggcgcccaggcgcccggtgcagtggaagggccggcgcgtaaagcgcgtcctgcgccccggcaccgcggtggtcttcacgcccggcgagcgctccacccggactttcaagcgcgtctatgacgaggtgtacggcgacgaagacctgctggagcaggccaacgagcgcttcggagagtttgcttacgggaagcgtcagcgggcgctggggaaggaggacctgctggcgctgccgctggaccagggcaaccccacccccagtctgaagcccgtgaccctgcagcaggtgctgccgagcagcgcaccctccgaggcgaagcggggtctgaagcgcgagggcggcgacctggcgcccaccgtgcagctcatggtgcccaagcggcagaggctggaggatgtgctggagaaaatgaaagtagaccccggtctgcagccggacatcagggtccgccccatcaagcaggtggcgccgggcctcggcgtgcagaccgtggacgtggtcatccccaccggcaactcccccgccgccgccaccactaccgctgcctccacggacatggagacacagaccgatcccgccgcagccgcagccgcagccgccgccgcgacctcctcggcggaggtgcagacggacccctggctgccgccggcgatgtcagctccccgcgcgcgtcgcgggcgcaggaagtacggcgccgccaacgcgctcctgcccgagtacgccttgcatccttccatcgcgcccacccccggctaccgaggctatacctaccgcccgcgaagagccaagggttccacccgccgtccccgccgacgcgccgccgccaccacccgccgccgccgccgcagacgccagcccgcactggctccagtctccgtgaggaaagtggcgcgcgacggacacaccctggtgctgcccagggcgcgctaccaccccagcatcgtttaaaagcctgttgtggttcttgcagatatggccctcacttgccgcctccgtttcccggtgccgggataccgaggaggaagatcgcgccgcaggaggggtctggccggccgcggcctgagcggaggcagccgccgcgcgcaccggcggcgacgcgccaccagccgacgcatgcgcggcggggtgctgcccctgttaatccccctgatcgccgcggcgatcggcgccgtgcccgggatcgcctccgtggccttgcaagcgtcccagaggcattgacagacttgcaaacttgcaaatatggaaaaaaaaaccccaataaaaaagtctagactctcacgctcgcttggtcctgtgactattttgtagaatggaagacatcaactttgcgtcgctggccccgcgtcacggctcgcgcccgttcctgggacactggaacgatatcggcaccagcaacatgagcggtggcgccttcagttggggctctctgtggagcggcattaaaagtatcgggtctgccgttaaaaattacggctcccgggcctggaacagcagcacgggccagatgttgagagacaagttgaaagagcagaacttccagcagaaggtggtggagggcctggcctccggcatcaacggggtggtggacctggccaaccaggccgtgcagaataagatcaacagcagactggacccccggccgccggtggaggaggtgccgccggcgctggagacggtgtcccccgatgggcgtggcgagaagcgcccgcggcccgatagggaagagaccactctggtcacgcagaccgatgagccgcccccgtatgaggaggccctgaagcaaggtctgcccaccacgcggcccatcgcgcccatggccaccggggtggtgggccgccacacccccgccacgctggacttgcctccgcccgccgatgtgccgcagcagcagaaggcggcacagccgggcccgcccgcgaccgcctcccgttcctccgccggtcctctgcgccgcgcggccagcggcccccgcgggggggtcgcgaggcacggcaactggcagagcacgctgaacagcatcgtgggtctgggggtgcggtccgtgaagcgccgccgatgctactgaatagcttagctaacgtgttgtatgtgtgtatgcgccctatgtcgccgccagaggagctgctgagtcgccgccgttcgcgcgcccaccaccaccgccactccgcccctcaagatggcgaccccatcgatgatgccgcagtggtcgtacatgcacatctcgggccaggacgcctcggagtacctgagccccgggctggtgcagttcgcccgcgccaccgagagctacttcagcctgagtaacaagtttaggaaccccacggtggcgcccacgcacgatgtgaccaccgaccggtctcagcgcctgacgctgcggttcattcccgtggaccgcgaggacaccgcgtactcgtacaaggcgcggttcaccctggccgtgggcgacaaccgcgtgctggacatggcctccacctactttgacatccgcggggtgctggaccggggtcccactttcaagccctactctggcaccgcctacaactccctggcccccaagggcgctcccaactcctgcgagtgggagcaagaggaaactcaggcagttgaagaagcagcagaagaggaagaagaagatgctgacggtcaagctgaggaagagcaagcagctaccaaaaagactcatgtatatgctcaggctcccctttctggcgaaaaaattagtaaagatggtctgcaaataggaacggacgctacagctacagaacaaaaacctatttatgcagaccctacattccagcccgaaccccaaatcggggagtcccagtggaatgaggcagatgctacagtcgccggcggtagagtgctaaagaaatctactcccatgaaaccatgctatggttcctatgcaagacccacaaatgctaatggaggtcagggtgtactaacggcaaatgcccagggacagctagaatctcaggttgaaatgcaattcttttcaacttctgaaaacgcccgtaacgaggctaacaacattcagcccaaattggtgctgtatagtgaggatgtgcacatggagaccccggatacgcacctttcttacaagcccgcaaaaagcgatgacaattcaaaaatcatgctgggtcagcagtccatgcccaacagacctaattacatcggcttcagagacaactttatcggcctcatgtattacaatagcactggcaacatgggagtgcttgcaggtcaggcctctcagttgaatgcagtggtggacttgcaagacagaaacacagaactgtcctaccagctcttgcttgattccatgggtgacagaaccagatacttttccatgtggaatcaggcagtggacagttatgacccagatgttagaattattgaaaatcatggaactgaagacgagctccccaactattgtttccctctgggtggcataggggtaactgacacttaccaggctgttaaaaccaacaatggcaataacgggggccaggtgacttggacaaaagatgaaacttttgcagatcgcaatgaaataggggtgggaaacaatttcgctatggagatcaacctcagtgccaacctgtggagaaacttcctgtactccaacgtggcgctgtacctaccagacaagcttaagtacaacccctccaatgtggacatctctgacaaccccaacacctacgattacatgaacaagcgagtggtggccccggggctggtggactgctacatcaacctgggcgcgcgctggtcgctggactacatggacaacgtcaaccccttcaaccaccaccgcaatgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggtaacgatctcagggtggacggggccagcatcaagttcgagagcatctgcctctacgccaccttcttccccatggcccacaacacggcctccacgctcgaggccatgctcaggaacgacaccaacgaccagtccttcaatgactacctctccgccgccaacatgctctaccccatacccgccaacgccaccaacgtccccatctccatcccctcgcgcaactgggcggccttccgcggctgggccttcacccgcctcaagaccaaggagaccccctccctgggctcgggattcgacccctactacacctactcgggctccattccctacctggacggcaccttctacctcaaccacactttcaagaaggtctcggtcaccttcgactcctcggtcagctggccgggcaacgaccgtctgctcacccccaacgagttcgagatcaagcgctcggtcgacggggagggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctatccgctcataggcaagaccgcggtcgacagcatcacccagaaaaagttcctctgcgaccgcaccctctggcgcatccccttctccagcaacttcatgtccatgggtgcgctctcggacctgggccagaacttgctctacgccaactccgcccacgccctcgacatgaccttcgaggtcgaccccatggacgagcccacccttctctatgttctgttcgaagtctttgacgtggtccgggtccaccagccgcaccgcggcgtcatcgagaccgtgtacctgcgtacgcccttctcggccggcaacgccaccacctaaagaagcaagccgcagtcatcgccgcctgcatgccgtcgggttccaccgagcaagagctcagggccatcgtcagagacctgggatgcgggccctattttttgggcaccttcgacaagcgcttccctggctttgtctccccacacaagctggcctgcgccatcgtcaacacggccggccgcgagaccgggggcgtgcactggctggccttcgcctggaacccgcgctccaaaacatgcttcctctttgaccccttcggcttttcggaccagcggctcaagcaaatctacgagttcgagtacgagggcttgctgcgtcgcagcgccatcgcctcctcgcccgaccgctgcgtcaccctcgaaaagtccacccagaccgtgcaggggcccgactcggccgcctgcggtctcttctgctgcatgtttctgcacgcctttgtgcactggcctcagagtcccatggaccgcaaccccaccatgaacttgctgacgggggtgcccaactccatgctccagagcccccaggtcgagcccaccctgcgccgcaaccaggagcagctctacagcttcctggagcgccactcgccttacttccgccgccacagcgcacagatcaggagggccacctccttctgccacttgcaagagatgcaagaagggtaataacgatgtacacactttttttctcaataaatggcatctttttatttatacaagctctctggggtattcatttcccaccaccacccgccgttgtcgccatctggctctatttagaaatcgaaagggttctgccgggagtcgccgtgcgccacgggcagggacacgttgcgatactggtagcgggtgccccacttgaactcgggcaccaccaggcgaggcagctcggggaagttttcgctccacaggctgcgggtcagcaccagcgcgttcatcaggtcgggcgccgagatcttgaagtcgcagttggggccgccgccctgcgcgcgcgagttgcggtacaccgggttgcagcactggaacaccaacagcgccgggtgcttcacgctggccagcacgctgcggtcggagatcagctcggcgtccaggtcctccgcgttgctcagcgcgaacggggtcatcttgggcacttgccgccccaggaagggcgcgtgccccggtttcgagttgcagtcgcagcgcagcgggatcagcaggtgcccgtgcccggactcggcgttggggtacagcgcgcgcatgaaggcctgcatctggcggaaggccatctgggccttggcgccctccgagaagaacatgccgcaggacttgcccgagaactggtttgcggggcagctggcgtcgtgcaggcagcagcgcgcgtcggtgttggcgatctgcaccacgttgcgcccccaccggttcttcacgatcttggccttggacgattgctccttcagcgcgcgctgcccgttctcgctggtcacatccatctcgatcacatgttccttgttcaccatgctgctgccgtgcagacacttcagctcgccctccgtctcggtgcagcggtgctgccacagcgcgcagcccgtgggctcgaaagacttgtaggtcacctccgcgaaggactgcaggtacccctgcaaaaagcggcccatcatggtcacgaaggtcttgttgctgctgaaggtcagctgcagcccgcggtgctcctcgttcagccaggtcttgcacacggccgccagcgcctccacctggtcgggcagcatcttgaagttcaccttcagctcattctccacgtggtacttgtccatcagcgtgcgcgccgcctccatgcccttctcccaggccgacaccagcggcaggctcacggggttcttcaccatcaccgtggccgccgcctccgccgcgctttcgctttccgccccgctgttctcttcctcttcctcctcttcctcgccgccgcccactcgcagcccccgcaccacggggtcgtcttcctgcaggcgctgcaccttgcgcttgccgttgcgcccctgcttgatgcgcacgggcgggttgctgaagcccaccatcaccagcgcggcctcttcttgctcgtcctcgctgtccagaatgacctccggggagggggggttggtcatcctcagtaccgaggcacgcttctttttcttcctgggggcgttcgccagctccgcggctgcggccgctgccgaggtcgaaggccgagggctgggcgtgcgcggcaccagcgcgtcctgcgagccgtcctcgtcctcctcggactcgagacggaggcgggcccgcttcttcgggggcgcgcggggcggcggaggcggcggcggcgacggagacggggacgagacatcgtccagggtgggtggacggcgggccgcgccgcgtccgcgctcgggggtggtctcgcgctggtcctcttcccgactggccatctcccactgctccttctcctataggcagaaagagatcatggagtctctcatgcgagtcgagaaggaggaggacagcctaaccgccccctctgagccctccaccaccgccgccaccaccgccaatgccgccgcggacgacgcgcccaccgagaccaccgccagtaccaccctccccagcgacgcacccccgctcgagaatgaagtgctgatcgagcaggacccgggttttgtgagcggagaggaggatgaggtggatgagaaggagaaggaggaggtcgccgcctcagtgccaaaagaggataaaaagcaagaccaggacgacgcagataaggatgagacagcagtcgggcgggggaacggaagccatgatgctgatgacggctacctagacgtgggagacgacgtgctgcttaagcacctgcaccgccagtgcgtcatcgtctgcgacgcgctgcaggagcgctgcgaagtgcccctggacgtggcggaggtcagccgcgcctacgagcggcacctcttcgcgccgcacgtgccccccaagcgccgggagaacggcacctgcgagcccaacccgcgtctcaacttctacccggtcttcgcggtacccgaggtgctggccacctaccacatctttttccaaaactgcaagatccccctctcctgccgcgccaaccgcacccgcgccgacaaaaccctgaccctgcggcagggcgcccacatacctgatatcgcctctctggaggaagtgcccaagatcttcgagggtctcggtcgcgacgagaaacgggcggcgaacgctctgcacggagacagcgaaaacgagagtcactcgggggtgctggtggagctcgagggcgacaacgcgcgcctggccgtactcaagcgcagcatagaggtcacccactttgcctacccggcgctcaacctgccccccaaggtcatgagtgtggtcatgggcgagctcatcatgcgccgcgcccagcccctggccgcggatgcaaacttgcaagagtcctccgaggaaggcctgcccgcggtcagcgacgagcagctggcgcgctggctggagacccgcgaccccgcgcagctggaggagcggcgcaagctcatgatggccgcggtgctggtcaccgtggagctcgagtgtctgcagcgcttcttcgcggaccccgagatgcagcgcaagctcgaggagaccctgcactacaccttccgccagggctacgtgcgccaggcctgcaagatctccaacgtggagctctgcaacctggtctcctacctgggcatcctgcacgagaaccgcctcgggcagaacgtcctgcactccaccctcaaaggggaggcgcgccgcgactacatccgcgactgcgcctacctcttcctctgctacacctggcagacggccatgggggtctggcagcagtgcctggaggagcgcaacctcaaggagctggaaaagctcctcaagcgcaccctcagggacctctggacgggcttcaacgagcgctcggtggccgccgcgctggcggacatcatctttcccgagcgcctgctcaagaccctgcagcagggcctgcccgacttcaccagccagagcatgctgcagaacttcaggactttcatcctggagcgctcgggcatcctgccggccacttgctgcgcgctgcccagcgacttcgtgcccatcaagtacagggagtgcccgccgccgctctggggccactgctacctcttccagctggccaactacctcgcctaccactcggacctcatggaagacgtgagcggcgagggcctgctcgagtgccactgccgctgcaacctctgcacgccccaccgctctctagtctgcaacccgcagctgctcagcgagagtcagattatcggtaccttcgagctgcagggtccctcgcctgacgagaagtccgcggctccagggctgaaactcactccggggctgtggacttccgcctacctacgcaaatttgtacctgaggactaccacgcccacgagatcaggttctacgaagaccaatcccgcccgcccaaggcggagctcaccgcctgcgtcatcacccaggggcacatcctgggccaattgcaagccatcaacaaagcccgccgagagttcttgctgaaaaagggtcggggggtgtacctggacccccagtccggcgaggagctaaacccgctacccccgccgccgccccagcagcgggaccttgcttcccaggatggcacccagaaagaagcagcagccgccgccgccgccgcagccatacatgcttctggaggaagaggaggaggactgggacagtcaggcagaggaggtttcggacgaggagcaggaggagatgatggaagactgggaggaggacagcagcctagacgaggaagcttcagaggccgaagaggtggcagacgcaacaccatcgccctcggtcgcagccccctcgccggggcccctgaaatcctccgaacccagcaccagcgctataacctccgctcctccggcgccggcgccacccgcccgcagacccaaccgtagatgggacaccacaggaaccggggtcggtaagtccaagtgcccgccgccgccaccgcagcagcagcagcagcagcgccagggctaccgctcgtggcgcgggcacaagaacgccatagtcgcctgcttgcaagactgcgggggcaacatctctttcgcccgccgcttcctgctattccaccacggggtcgcctttccccgcaatgtcctgcattactaccgtcatctctacagcccctactgcagcggcgacccagaggcggcagcggcagccacagcggcgaccaccacctaggaagatatcctccgcgggcaagacagcggcagcagcggccaggagacccgcggcagcagcggcgggagcggtgggcgcactgcgcctctcgcccaacgaacccctctcgacccgggagctcagacacaggatcttccccactttgtatgccatcttccaacagagcagaggccaggagcaggagctgaaaataaaaaacagatctctgcgctccctcacccgcagctgtctgtatcacaaaagcgaagatcagcttcggcgcacgctggaggacgcggaggcactcttcagcaaatactgcgcgctcactcttaaagactagctccgcgcccttctcgaatttaggcgggagaaaactacgtcatcgccggccgccgcccagcccgcccagccgagatgagcaaagagattcccacgccatacatgtggagctaccagccgcagatgggactcgcggcgggagcggcccaggactactccacccgcatgaactacatgagcgcgggaccccacatgatctcacaggtcaacgggatccgcgcccagcgaaaccaaatactgctggaacaggcggccatcaccgccacgccccgccataatctcaacccccgaaattggcccgccgccctcgtgtaccaggaaaccccctccgccaccaccgtactacttccgcgtgacgcccaggccgaagtccagatgactaactcaggggcgcagctcgcgggcggctttcgtcacggggcgcggccgctccgaccaggtataagacacctgatgatcagaggccgaggtatccagctcaacgacgagtcggtgagctcttcgctcggtctccgtccggacggaactttccagctcgccggatccggccgctcttcgttcacgccccgccaggcgtacctgactctgcagacctcgtcctcggagccccgctccggcggcatcggaaccctccagttcgtggaggagttcgtgccctcggtctacttcaaccccttctcgggacctcccggacgctaccccgaccagttcattccgaactttgacgcggtgaaggactcggcggacggctacgactgaatgtcaggtgtcgaggcagagcagcttcgcctgagacacctcgagcactgccgccgccacaagtgcttcgcccgcggttctggtgagttctgctactttcagctacccgaggagcataccgaggggccggcgcacggcgtccgcctgaccacccagggcgaggttacctgttccctcatccgggagtttaccctccgtcccctgctagtggagcgggagcggggtccctgtgtcctaactatcgcctgcaactgccctaaccctggattacatcaagatctttgctgtcatctctgtgctgagtttaataaacgctgagatcagaatctactggggctcctgtcgccatcctgtgaacgccaccgtcttcacccaccccgaccaggcccaggcgaacctcacctgcggtctgcatcggagggccaagaagtacctcacctggtacttcaacggcaccccctttgtggtttacaacagcttcgacggggacggagtctccctgaaagaccagctctccggtctcagctactccatccacaagaacaccaccctccaactcttccctccctacctgccgggaacctacgagtgcgtcaccggccgctgcacccacctcacccgcctgatcgtaaaccagagctttccgggaacagataactccctcttccccagaacaggaggtgagctcaggaaactccccggggaccagggcggagacgtaccttcgacccttgtggggttaggattttttattaccgggttgctggctcttttaatcaaagtttccttgagatttgttctttccttctacgtgtatgaacacctcaacctccaataactctaccctttcttcggaatcaggtgacttctctgaaatcgggcttggtgtgctgcttactctgttgatttttttccttatcatactcagccttctgtgcctcaggctcgccgcctgctgcgcacacatctatatctactgctggttgctcaagtgcaggggtcgccacccaagatgaacaggtacatggtcctatcgatcctaggcctgctggccctggcggcctgcagcgccgccaaaaaagagattacctttgaggagcccgcttgcaatgtaactttcaagcccgagggtgaccaatgcaccaccctcgtcaaatgcgttaccaatcatgagaggctgcgcatcgactacaaaaacaaaactggccagtttgcggtctatagtgtgtttacgcccggagacccctctaactactctgtcaccgtcttccagggcggacagtctaagatattcaattacactttccctttttatgagttatgcgatgcggtcatgtacatgtcaaaacagtacaacctgtggcctccctctccccaggcgtgtgtggaaaatactgggtcttactgctgtatggctttcgcaatcactacgctcgctctaatctgcacggtgctatacataaaattcaggcagaggcgaatctttatcgatgaaaagaaaatgccttgatcgctaacaccggctttctatctgcagaatgaatgcaatcacctccctactaatcaccaccaccctccttgcgattgcccatgggttgacacgaatcgaagtgccagtggggtccaatgtcaccatggtgggccccgccggcaattccaccctcatgtgggaaaaatttgtccgcaatcaatgggttcatttctgctctaaccgaatcagtatcaagcccagagccatctgcgatgggcaaaatctaactctgatcaatgtgcaaatgatggatgctgggtactattacgggcagcggggagaaatcattaattactggcgaccccacaaggactacatgctgcatgtagtcgaggcacttcccactaccacccccactaccacctctcccaccaccaccaccactactactactactactactactactactactaccactaccgctgcccgccatacccgcaaaagcaccatgattagcacaaagccccctcgtgctcactcccacgccggcgggcccatcggtgcgacctcagaaaccaccgagctttgcttctgccaatgcactaacgccagcgctcatgaactgttcgacctggagaatgaggatgtccagcagagctccgcttgcctgacccaggaggctgtggagcccgttgccctgaagcagatcggtgattcaataattgactcttcttcttttgccactcccgaataccctcccgattctactttccacatcacgggtaccaaagaccctaacctctctttctacctgatgctgctgctctgtatctctgtggtctcttccgcgctgatgttactggggatgttctgctgcctgatctgccgcagaaagagaaaagctcgctctcagggccaaccactgatgcccttcccctaccccccggattttgcagataacaagatatgagctcgctgctgacactaaccgctttactagcctgcgctctaacccttgtcgcttgcgactcgagattccacaatgtcacagctgtggcaggagaaaatgttactttcaactccacggccgatacccagtggtcgtggagtggctcaggtagctacttaactatctgcaatagctccacttcccccggcatatccccaaccaagtaccaatgcaatgccagcctgttcaccctcatcaacgcttccaccctggacaatggactctatgtaggctatgtaccctttggtgggcaaggaaagacccacgcttacaacctggaagttcgccagcccagaaccactacccaagcttctcccaccaccaccaccaccaccaccatcaccagcagcagcagcagcagcagccacagcagcagcagcagattattgactttggttttggccagctcatctgccgctacccaggccatctacagctctgtgcccgaaaccactcagatccaccgcccagaaacgaccaccgccaccaccctacacacctccagcgatcagatgccgaccaacatcacccccttggctcttcaaatgggacttacaagccccactccaaaaccagtggatgcggccgaggtctccgccctcgtcaatgactgggcggggctgggaatgtggtggttcgccataggcatgatggcgctctgcctgcttctgctctggctcatctgctgcctccaccgcaggcgagccagaccccccatctatagacccatcattgtcctgaaccccgataatgatgggatccatagattggatggcctgaaaaacctacttttttcttttacagtatgataaattgagacatgcctcgcattttcttgtacatgttccttctcccaccttttctggggtgttctacgctggccgctgtgtctcacctggaggtagactgcctctcacccttcactgtctacctgctttacggattggtcaccctcactctcatctgcagcctaatcacagtaatcatcgccttcatccagtgcattgattacatctgtgtgcgcctcgcatacttcagacaccacccgcagtaccgagacaggaacattgcccaacttctaagactgctctaatcatgcataagactgtgatctgccttctgatcctctgcatcctgcccaccctcacctcctgccagtacaccacaaaatctccgcgcaaaagacatgcctcctgccgcttcacccaactgtggaatatacccaaatgctacaacgaaaagagcgagctctccgaagcttggctgtatggggtcatctgtgtcttagttttctgcagcactgtctttgccctcataatctacccctactttgatttgggatggaacgcgatcgatgccatgaattaccccacctttcccgcacccgagataattccactgcgacaagttgtacccgttgtcgttaatcaacgccccccatcccctacgcccactgaaatcagctactttaacctaacaggcggagatgactgacgccctagatctagaaatggacggcatcagtaccgagcagcgtctcctagagaggcgcaggcaggcggctgagcaagagcgcctcaatcaggagctccgagatctcgttaacctgcaccagtgcaaaagaggcatcttttgtctggtaaagcaggccaaagtcacctacgagaagaccggcaacagccaccgcctcagttacaaattgcccacccagcgccagaagctggtgctcatggtgggtgagaatcccatcaccgtcacccagcactcggtagagaccgaggggtgtctgcactccccctgtcggggtccagaagacctctgcaccctggtaaagaccctgtgcggtctcagagatttagtcccctttaactaatcaaacactggaatcaataaaaagaatcacttacttaaaatcagacagcaggtctctgtccagtttattcagcagcacctccttcccctcctcccaactctggtactccaaacgccttctggcggcaaacttcctccacaccctgaagggaatgtcagattcttgctcctgtccctccgcacccactatcttcatgttgttgcagatgaagcgcaccaaaacgtctgacgagagcttcaaccccgtgtacccctatgacacggaaagcggccctccctccgtccctttcctcacccctcccttcgtgtctcccgatggattccaagaaagtccccccggggtcctgtctctgaacctggccgagcccctggtcacttcccacggcatgctcgccctgaaaatgggaagtggcctctccctggacgacgctggcaacctcacctctcaagatatcaccaccgctagccctcccctcaaaaaaaccaagaccaacctcagcctagaaacctcatcccccctaactgtgagcacctcaggcgccctcaccgtagcagccgccgctcccctggcggtggccggcacctccctcaccatgcaatcagaggcccccctgacagtacaggatgcaaaactcaccctggccaccaaaggccccctgaccgtgtctgaaggcaaactggccttgcaaacatcggccccgctgacggccgctgacagcagcaccctcacagtcagtgccacaccaccccttagcacaagcaatggcagcttgggtattgacatgcaagcccccatttacaccaccaatggaaaactaggacttaactttggcgctcccctgcatgtggtagacagcctaaatgcactgactgtagttactggccaaggtcttacgataaacggaacagccctacaaactagagtctcaggtgccctcaactatgacacatcaggaaacctagaattgagagctgcagggggtatgcgagttgatgcaaatggtcaacttatccttgatgtagcttacccatttgatgcacaaaacaatctcagccttaggcttggacagggacccctgtttgttaactctgcccacaacttggatgttaactacaacagaggcctctacctgttcacatctggaaataccaaaaagctagaagttaatatcaaaacagccaagggtctcatttatgatgacactgctatagcaatcaatgcgggtgatgggctacagtttgactcaggctcagatacaaatccattaaaaactaaacttggattaggactggattatgactccagcagagccataattgctaaactgggaactggcctaagctttgacaacacaggtgccatcacagtaggcaacaaaaatgatgacaagcttaccttgtggaccacaccagacccatcccctaactgtagaatctattcagagaaagatgctaaattcacacttgttttgactaaatgcggcagtcaggtgttggccagcgtttctgttttatctgtaaaaggtagccttgcgcccatcagtggcacagtaactagtgctcagattgtcctcagatttgatgaaaatggagttctactaagcaattcttcccttgaccctcaatactggaactacagaaaaggtgaccttacagagggcactgcatataccaacgcagtgggatttatgcccaacctcacagcatacccaaaaacacagagccaaactgctaaaagcaacattgtaagtcaggtttacttgaatggggacaaatccaaacccatgaccctcaccattaccctcaatggaactaatgaaacaggagatgccacagtaagcacttactccatgtcattctcatggaactggaatggaagtaattacattaatgaaacgttccaaaccaactccttcaccttctcctacatcgcccaagaataaaaagcatgacgctgttgatttgattcaatgtgtttctgttttattttcaagcacaacaaaatcattcaagtcattcttccatcttagcttaatagacacagtagcttaatagacccagtagtgcaaagccccattctagcttatagatcagacagtgataattaaccaccaccaccaccataccttttgattcaggaaatcatgatcatcacaggatcctagtcttcaggccgccccctccctcccaagacacagaatacacagtcctctccccccgactggctttaaataacaccatctggttggtcacagacatgttcttaggggttatattccacacggtctcctgccgcgccaggcgctcgtcggtgatgttgataaactctcccggcagctcgctcaagttcacgtcgctgtccagcggctgaacctccggctgacgcgataactgtgcgaccggctgctggacgaacggaggccgcgcctacaagggggtagagtcataatcctcggtcaggatagggcggtgatgcagcagcagcgagcgaaacatctgctgccgccgccgctccgtccggcaggaaaacaacacgccggtggtctcctccgcgataatccgcaccgcccgcagcatcagcttcctcgttctccgcgcgcagcacctcacccttatctcgctcaaatcggcgcagtaggtacagcacagcaccacgatgttattcatgatcccacagtgcagggcgctgtatccaaagctcatgccgggaaccaccgcccccacgtggccatcgtaccacaagcgcacgtaaatcaagtgtcgacccctcatgaacgcgctggacacaaacattacttccttgggcatgttgtaattcaccacctcccggtaccagataaacctctggttgaacagggcaccttccaccaccatcctgaaccaagaggccagaacctgcccaccggctatgcactgcagggaacccgggttggaacaatgacaatgcagactccaaggctcgtaaccgtggatcatccggctgctgaaggcatcgatgttggcacaacacagacacacgtgcatgcactttctcatgattagcagctcttccctcgtcaggatcatatcccaaggaataacccattcttgaatcaacgtaaaacccacacagcagggaaggcctcgcacataactcacgttgtgcatggtcagcgtgttgcattccggaaacagcggatgatcctccagtatcgaggcgcgggtctccttctcacagggaggtaaagggtccctgctgtacggactgcgccgggacgaccgagatcgtgttgagcgtagtgtcatggaaaagggaacgccggacgtggtcatacttcttgaagcagaaccaggttcgcgcgtggcaggcctccttgcgtctgcggtctcgccgtctagctcgctccgtgtgatagttgtagtacagccactcccgcagagcgtcgaggcgcaccctggcttccggatctatgtagactccgtcttgcaccgcggccctgataatatccaccaccgtagaataagcaacacccagccaagcaatacactcgctctgcgagcggcagacaggaggagcgggcagagatgggagaaccatgataaaaaactttttttaaagaatattttccaattcttcgaaagtaagatctatcaagtggcagcgctcccctccactggcgcggtcaaactctacggccaaagcacagacaacggcatttctaagatgttccttaatggcgtccaaaagacacaccgctctcaagttgcagtaaactatgaatgaaaacccatccggctgattttccaatatagacgcgccggcagcgtccaccaaacccagataattttcttctctccagcggtttacgatctgtctaagcaaatcccttatatcaagtccgaccatgccaaaaatctgctcaagagcgccctccaccttcatgtacaagcagcgcatcatgattgcaaaaattcaggttcttcagagacctgtataagattcaaaatgggaacattaacaaaaattcctctgtcgcgcagatcccttcgcagggcaagctgaacataatcagacaggtccgaacggaccagtgaggccaaatccccaccaggaaccagatccagagaccctatactgattatgacgcgcatactcggggctatgctgaccagcgtagcgccgatgtaggcgtgctgcatgggcggcgagataaaatgcaaagtgctggttaaaaaatcaggcaaagcctcgcgcaaaaaagctaacacatcataatcatgctcatgcaggtagttgcaggtaagctcaggaaccaaaacggaataacacacgattttcctctcaaacatgacttcgcggatactgcgtaaaacaaaaaattataaataaaaaattaattaaataacttaaacattggaagcctgtctcacaacaggaaaaaccactttaatcaacataagacgggccacgggcatgccggcatagccgtaaaaaaattggtccccgtgattaacaagtaccacagacagctccccggtcatgtcgggggtcatcatgtgagactctgtatacacgtctggattgtgaacatcagacaaacaaagaaatcgagccacgtagcccggaggtataatcacccgcaggcggaggtacagcaaaacgacccccataggaggaatcacaaaattagtaggagaaaaaaatacataaacaccagaaaaaccctgttgctgaggcaaaatagcgccctcccgatccaaaacaacataaagcgcttccacaggagcagccataacaaagacccgagtcttaccagtaaaagaaaaaagatctctcaacgcagcaccagcaccaacacttcgcagtgtaaaaggccaagtgccgagagagtatatataggaataaaaagtgacgtaaacgggcaaagtccaaaaaacgcccagaaaaaccgcacgcgaacctacgccccgaaacgaaagccaaaaaacactagacactcccttccggcgtcaacttccgctttcccacgctacgtcacttcccccggtcaaacaaactacatatcccgaacttccaagtcgccacgcccaaaacaccgcctacacctccccgcccgccggcccgcccccggacccgcctcccgccccgcgccgcccatctcattatcatattggcttcaatccaaaataaggtatattattgatgatg

SEQ ID NO: 11 - DNA, 37559 bp, Artificial
  synthetic polynucleotide
catcatcaataatataccttattttggattgaagccaatatgataatgagatgggcggcgcggggcggggcgcggggcgggaggcgggtttgggggcgggccggcgggcggggcggtgtggcggaagtggactttgtaagtgtggcggatgtgacttgctagtgccgggcgcggtaaaagtgacgttttccgtgcgcgacaacgcccccgggaagtgacatttttcccgcggtttttaccggatgttgtagtgaatttgggcgtaaccaagtaagatttggccattttcgcgggaaaactgaaacggggaagtgaaatctgattaattttgcgttagtcataccgcgtaatatttgtctagggccgagggactttggccgattacgtggaggactcgcccaggtgttttttgaggtgaatttccgcgttccgggtcaaagtctgcgttttattattataggatatcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccgcggccgggaacggtgcattggaacgcggattccccgtgccaagagtgagatcttccgtttatctaggtaccagatatcgccaccatggaactgctgatcctgaaggccaacgccatcaccaccatcctgaccgccgtgaccttctgcttcgccagcggccagaacatcaccgaggaattctaccagagcacctgtagcgccgtgagcaagggctacctgagcgccctgagaaccggctggtacaccagcgtgatcaccatcgagctgagcaacatcaaagaaaacaagtgcaacggcaccgacgccaaagtgaagctgatcaagcaggaactggacaagtacaagaacgccgtgaccgagctgcagctgctgatgcagagcacccccgccaccaacaaccgggccagacgggagctgccccggttcatgaactacaccctgaacaacgccaaaaagaccaacgtgaccctgagcaagaagcggaagcggcggttcctgggctttctgctgggcgtgggcagcgccattgccagcggcgtggccgtgtctaaggtgctgcacctggaaggcgaagtgaacaagatcaagagcgccctgctgagcaccaacaaggccgtggtgtccctgagcaacggcgtgagcgtgctgaccagcaaggtgctggatctgaagaactacatcgacaagcagctgctgcccatcgtgaacaagcagagctgcagcatcagcaacatcgagacagtgatcgagttccagcagaagaacaaccggctgctggaaatcacccgggagttcagcgtgaacgccggcgtgaccacccctgtgtccacctacatgctgaccaacagcgagctgctgagcctgatcaacgacatgcccatcaccaacgaccagaaaaagctgatgagcaacaacgtgcagatcgtgcggcagcagagctactccatcatgtccatcatcaaagaagaggtgctggcctacgtggtgcagctgcccctgtacggcgtgatcgacaccccctgctggaagctgcacaccagccccctgtgcaccaccaacaccaaagagggcagcaacatctgcctgacccggaccgacagaggctggtactgcgacaacgccggcagcgtgtcattctttccacaggccgagacatgcaaggtgcagagcaaccgggtgttctgcgacaccatgaacagcctgaccctgccctccgaagtgaacctgtgcaacgtggacatcttcaaccccaagtacgactgcaagatcatgacctccaagaccgacgtgtccagctccgtgatcacctccctgggcgccatcgtgtcctgctacggcaagaccaagtgcaccgccagcaacaagaaccggggcatcatcaagaccttcagcaacggctgcgactacgtgtccaacaagggggtggacaccgtgtccgtgggcaacaccctgtactacgtgaacaaacaggaaggcaagagcctgtacgtgaagggcgagcccatcatcaacttctacgaccccctggtgttccccagcgacgagttcgacgccagcatcagccaggtgaacgagaagatcaaccagagcctggccttcatccggaagtccgacgagctgctgcacaatgtgaatgccggcaagtccaccaccaaccggaagcggagagcccctgtgaagcagaccctgaacttcgacctgctgaagctggccggcgacgtggagagcaatcccggccctatggccctgagcaaagtgaaactgaacgatacactgaacaaggaccagctgctgtccagcagcaagtacaccatccagcggagcaccggcgacagcatcgatacccccaactacgacgtgcagaagcacatcaacaagctgtgcggcatgctgctgatcacagaggacgccaaccacaagttcaccggcctgatcggcatgctgtacgccatgagccggctgggccgggaggacaccatcaagatcctgcgggacgccggctaccacgtgaaggccaatggcgtggacgtgaccacacaccggcaggacatcaacggcaaagaaatgaagttcgaggtgctgaccctggccagcctgaccaccgagatccagatcaatatcgagatcgagagccggaagtcctacaagaaaatgctgaaagaaatgggcgaggtggcccccgagtacagacacgacagccccgactgcggcatgatcatcctgtgtatcgccgccctggtgatcacaaagctggccgctggcgacagatctggcctgacagccgtgatcagacgggccaacaatgtgctgaagaacgagatgaagcggtacaagggcctgctgcccaaggacattgccaacagcttctacgaggtgttcgagaagtacccccacttcatcgacgtgttcgtgcacttcggcattgcccagagcagcaccagaggcggctccagagtggagggcatcttcgccggcctgttcatgaacgcctacggcgctggccaggtgatgctgagatggggcgtgctggccaagagcgtgaagaacatcatgctgggccacgccagcgtgcaggccgagatggaacaggtggtggaggtgtacgagtacgcccagaagctgggcggagaggccggcttctaccacatcctgaacaaccctaaggcctccctgctgtccctgacccagttcccccacttctccagcgtggtgctgggaaatgccgccggactgggcatcatgggcgagtaccggggcacccccagaaaccaggacctgtacgacgccgccaaggcctacgccgagcagctgaaagaaaacggcgtgatcaactacagcgtgctggacctgaccgctgaggaactggaagccatcaagcaccagctgaaccccaaggacaacgacgtggagctgggaggcggaggatctggcggcggaggcatgagcagacggaacccctgcaagttcgagatccggggccactgcctgaacggcaagcggtgccacttcagccacaactacttcgagtggccccctcatgctctgctggtgcggcagaacttcatgctgaaccggatcctgaagtccatggacaagagcatcgacaccctgagcgagatcagcggagccgccgagctggacagaaccgaggaatatgccctgggcgtggtgggagtgctggaaagctacatcggctccatcaacaacatcacaaagcagagcgcctgcgtggccatgagcaagctgctgacagagctgaacagcgacgacatcaagaagctgagggacaacgaggaactgaacagccccaagatccgggtgtacaacaccgtgatcagctacattgagagcaaccgcaagaacaacaagcagaccatccatctgctgaagcggctgcccgccgacgtgctgaaaaagaccatcaagaacaccctggacatccacaagtccatcaccatcaacaatcccaaagaaagcaccgtgtctgacaccaacgatcacgccaagaacaacgacaccacctgatgagcggccgcgatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggccgatcagcgatcgctgaggtgggtgagtgggcgtggcctggggtggtcatgaaaatatataagttgggggtcttagggtctctttatttgtgttgcagagaccgccggagccatgagcgggagcagcagcagcagcagtagcagcagcgccttggatggcagcatcgtgagcccttatttgacgacgcggatgccccactgggccggggtgcgtcagaatgtgatgggctccagcatcgacggccgacccgtcctgcccgcaaattccgccacgctgacctatgcgaccgtcgcggggacgccgttggacgccaccgccgccgccgccgccaccgcagccgcctcggccgtgcgcagcctggccacggactttgcattcctgggaccactggcgacaggggctacttctcgggccgctgctgccgccgttcgcgatgacaagctgaccgccctgctggcgcagttggatgcgcttactcgggaactgggtgacctttctcagcaggtcatggccctgcgccagcaggtctcctccctgcaagctggcgggaatgcttctcccacaaatgccgtttaagataaataaaaccagactctgtttggattaaagaaaagtagcaagtgcattgctctctttatttcataattttccgcgcgcgataggccctagaccagcgttctcggtcgttgagggtgcggtgtatcttctccaggacgtggtagaggtggctctggacgttgagatacatgggcatgagcccgtcccgggggtggaggtagcaccactgcagagcttcatgctccggggtggtgttgtagatgatccagtcgtagcaggagcgctgggcatggtgcctaaaaatgtccttcagcagcaggccgatggccagggggaggcccttggtgtaagtgtttacaaaacggttaagttgggaagggtgcattcggggagagatgatgtgcatcttggactgtatttttagattggcgatgtttccgcccagatcccttctgggattcatgttgtgcaggaccaccagtacagtgtatccggtgcacttggggaatttgtcatgcagcttagagggaaaagcgtggaagaacttggagacgcctttgtggcctcccagattttccatgcattcgtccatgatgatggcaatgggcccgcgggaggcagcttgggcaaagatatttctggggtcgctgacgtcgtagttgtgttccagggtgaggtcgtcataggccatttttacaaagcgcgggcggagggtgcccgactgggggatgatggtcccctctggccctggggcgtagttgccctcgcagatctgcatttcccaggccttaatctcggaggggggaatcatatccacctgcggggcgatgaagaaaacggtttccggagccggggagattaactgggatgagagcaggtttctaagcagctgtgattttccacaaccggtgggcccataaataacacctataaccggttgcagctggtagtttagagagctgcagctgccgtcgtcccggaggaggggggccacctcgttgagcatgtccctgacgcgcatgttctccccgaccagatccgccagaaggcgctcgccgcccagggacagcagctcttgcaaggaagcaaagtttttcagcggcttgaggccgtccgccgtgggcatgtttttcagggtctggctcagcagctccaggcggtcccagagctcggtgacgtgctctacggcatctctatccagcatatctcctcgtttcgcgggttggggcgactttcgctgtagggcaccaagcggtggtcgtccagcggggccagagtcatgtccttccatgggcgcagggtcctcgtcagggtggtctgggtcacggtgaaggggtgcgctccgggctgagcgcttgccaaggtgcgcttgaggctggttctgctggtgctgaagcgctgccggtcttcgccctgcgcgtcggccaggtagcatttgaccatggtgtcatagtccagcccctccgcggcgtgtcccttggcgcgcagcttgcccttggaggtggcgccgcacgaggggcagagcaggctcttgagcgcgtagagcttgggggcgaggaagaccgattcgggggagtaggcgtccgcgccgcagaccccgcacacggtctcgcactccaccagccaggtgagctcggggcgcgccgggtcaaaaaccaggtttcccccatgctttttgatgcgtttcttacctcgggtctccatgaggtggtgtccccgctcggtgacgaagaggctgtccgtgtctccgtagaccgacttgaggggtcttttctccaggggggtccctcggtcttcctcgtagaggaactcggaccactctgagacgaaggcccgcgtccaggccaggacgaaggaggctatgtgggaggggtagcggtcgttgtccactagggggtccaccttctccaaggtgtgaagacacatgtcgccttcctcggcgtccaggaaggtgattggcttgtaggtgtaggccacgtgaccgggggttcctgacgggggggtataaaagggggtgggggcgcgctcgtcgtcactctcttccgcatcgctgtctgcgagggccagctgctggggtgagtattccctctcgaaggcgggcatgacctccgcgctgaggttgtcagtttccaaaaacgaggaggatttgatgttcacctgtcccgaggtgatacctttgagggtacccgcgtccatctggtcagaaaacacgatctttttattgtccagcttggtggcgaacgacccgtagagggcgttggagagcagcttggcgatggagcgcagggtctggttcttgtccctgtcggcgcgctccttggccgcgatgttgagctgcacgtactcgcgcgcgacgcagcgccactcggggaagacggtggtgcgctcgtcgggcaccaggcgcacgcgccagccgcggttgtgcagggtgaccaggtccacgctggtggcgacctcgccgcgcaggcgctcgttggtccagcagagacggccgcccttgcgcgagcagaaggggggcagggggtcgagctgggtctcgtccggggggtccgcgtccacggtgaaaaccccggggcgcaggcgcgcgtcgaagtagtctatcttgcaaccttgcatgtccagcgcctgctgccagtcgcgggcggcgagcgcgcgctcgtaggggttgagcggcgggccccagggcatggggtgggtgagtgcggaggcgtacatgccgcagatgtcatagacgtagaggggctcccgcaggaccccgatgtaggtggggtagcagcggccgccgcggatgctggcgcgcacgtagtcatacagctcgtgcgagggggcgaggaggtcggggcccaggttggtgcgggcggggcgctccgcgcggaagacgatctgcctgaagatggcatgcgagttggaagagatggtggggcgctggaagacgttgaagctggcgtcctgcaggccgacggcgtcgcgcacgaaggaggcgtaggagtcgcgcagcttgtgtaccagctcggcggtgacctgcacgtcgagcgcgcagtagtcgagggtctcgcggatgatgtcatatttagcctgccccttctttttccacagctcgcggttgaggacaaactcttcgcggtctttccagtactcttggatcgggaaaccgtccggttccgaacggtaagagcctagcatgtagaactggttgacggcctggtaggcgcagcagcccttctccacggggagggcgtaggcctgcgcggccttgcggagcgaggtgtgggtcagggcgaaggtgtccctgaccatgactttgaggtactggtgcttgaagtcggagtcgtcgcagccgccccgctcccagagcgagaagtcggtgcgcttcttggagcgggggttgggcagagcgaaggtgacatcgttgaagaggattttgcccgcgcggggcatgaagttgcgggtgatgcggaagggccccggcacttcagagcggttgttgatgacctgggcggcgagcacgatctcgtcgaagccgttgatgttgtggcccacgatgtagagttccaggaagcggggccggccctttacggtgggcagcttctttagctcttcgtaggtgagctcctcgggcgaggcgaggccgtgctcggccagggcccagtccgcgaggtgcgggttgtctctgaggaaggacttccagaggtcgcgggccaggagggtctgcaggcggtctctgaaggtcctgaactggcggcccacggccattttttcgggggtgatgcagtagaaggtgagggggtcttgctgccagcggtcccagtcgagctgcagggcgaggtcgcgcgcggcggtgaccaggcgctcgtcgcccccgaatttcatgaccagcatgaagggcacgagctgctttccgaaggcccccatccaagtgtaggtctctacatcgtaggtgacaaagaggcgctccgtgcgaggatgcgagccgatcgggaagaactggatctcccgccaccagttggaggagtggctgttgatgtggtggaagtagaagtcccgtcgccgggccgaacactcgtgctggcttttgtaaaagcgagcgcagtactggcagcgctgcacgggctgtacctcatgcacgagatgcacctttcgcccgcgcacgaggaagccgaggggaaatctgagccccccgcctggctcgcggcatggctggttctcttctactttggatgcgtgtccgtctccgtctggctcctcgaggggtgttacggtggagcggaccaccacgccgcgcgagccgcaggtccagatatcggcgcgcggcggtcggagtttgatgacgacatcgcgcagctgggagctgtccatggtctggagctcccgcggcggcggcaggtcagccgggagttcttgcaggttcacctcgcagagtcgggccagggcgcggggcaggtctaggtggtacctgatctctaggggcgtgttggtggcggcgtcgatggcttgcaggagcccgcagccccggggggcgacgacggtgccccgcggggtggtggtggtggtggcggtgcagctcagaagcggtgccgcgggcgggcccccggaggtagggggggctccggtcccgcgggcaggggcggcagcggcacgtcggcgtggagcgcgggcaggagttggtgctgtgcccggaggttgctggcgaaggcgacgacgcggcggttgatctcctggatctggcgcctctgcgtgaagacgacgggcccggtgagcttgaacctgaaagagagttcgacagaatcaatctcggtgtcattgaccgcggcctggcgcaggatctcctgcacgtctcccgagttgtcttggtaggcgatctcggccatgaactgctcgatctcttcctcctggaggtctccgcgtccggcgcgttccacggtggccgccaggtcgttggagatgcgccccatgagctgcgagaaggcgttgagtccgccctcgttccagactcggctgtagaccacgcccccctggtcatcgcgggcgcgcatgaccacctgcgcgaggttgagctccacgtgccgcgcgaagacggcgtagttgcgcagacgctggaagaggtagttgagggtggtggcggtgtgctcggccacgaagaagttcatgacccagcggcgcaacgtggattcgttgatgtcccccaaggcctccagccgttccatggcctcgtagaagtccacggcgaagttgaaaaactgggagttgcgcgccgacacggtcaactcctcctccagaagacggatgagctcggcgacggtgtcgcgcacctcgcgctcgaaggctatggggatctcttcctccgctagcatcaccacctcctcctcttcctcctcttctggcacttccatgatggcttcctcctcttcggggggtggcggcggcggcggtgggggagggggcgctctgcgccggcggcggcgcaccgggaggcggtccacgaagcgcgcgatcatctccccgcggcggcggcgcatggtctcggtgacggcgcggccgttctcccgggggcgcagttggaagacgccgccggacatctggtgctggggcgggtggccgtgaggcagcgagacggcgctgacgatgcatctcaacaattgctgcgtaggtacgccgccgagggacctgagggagtccatatccaccggatccgaaaacctttcgaggaaggcgtctaaccagtcgcagtcgcaaggtaggctgagcaccgtggcgggcggcggggggtggggggagtgtctggcggaggtgctgctgatgatgtaattgaagtaggcggacttgacacggcggatggtcgacaggagcaccatgtccttgggtccggcctgctggatgcggaggcggtcggctatgccccaggcttcgttctggcatcggcgcaggtccttgtagtagtcttgcatgagcctttccaccggcacctcttctccttcctcttctgcttcttccatgtctgcttcggccctggggcggcgccgcgcccccctgccccccatgcgcgtgaccccgaaccccctgagcggttggagcagggccaggtcggcgacgacgcgctcggccaggatggcctgctgcacctgcgtgagggtggtttggaagtcatccaagtccacgaagcggtggtaggcgcccgtgttgatggtgtaggtgcagttggccatgacggaccagttgacggtctggtggcccggttgcgacatctcggtgtacctgagtcgcgagtaggcgcgggagtcgaagacgtagtcgttgcaagtccgcaccaggtactggtagcccaccaggaagtgcggcggcggctggcggtagaggggccagcgcagggtggcgggggctccgggggccaggtcttccagcatgaggcggtggtaggcgtagatgtacctggacatccaggtgatacccgcggcggtggtggaggcgcgcgggaagtcgcgcacccggttccagatgttgcgcaggggcagaaagtgctccatggtaggcgtgctctgtccagtcagacgcgcgcagtcgttgatactctagaccagggaaaacgaaagccggtcagcgggcactcttccgtggtctggtgaatagatcgcaagggtatcatggcggagggcctcggttcgagccccgggtccgggccggacggtccgccatgatccacgcggttaccgcccgcgtgtcgaacccaggtgtgcgacgtcagacaacggtggagtgttccttttggcgtttttctggccgggcgccggcgccgcgtaagagactaagccgcgaaagcgaaagcagtaagtggctcgctccccgtagccggagggatccttgctaagggttgcgttgcggcgaaccccggttcgaatcccgtactcgggccggccggacccgcggctaaggtgttggattggcctccccctcgtataaagaccccgcttgcggattgactccggacacggggacgagccccttttatttttgctttccccagatgcatccggtgctgcggcagatgcgccccccgccccagcagcagcaacaacaccagcaagagcggcagcaacagcagcgggagtcatgcagggccccctcacccaccctcggcgggccggccacctcggcgtccgcggccgtgtctggcgcctgcggcggcggcggggggccggctgacgaccccgaggagcccccgcggcgcagggccagacactacctggacctggaggagggcgagggcctggcgcggctgggggcgccgtctcccgagcgccacccgcgggtgcagctgaagcgcgactcgcgcgaggcgtacgtgcctcggcagaacctgttcagggaccgcgcgggcgaggagcccgaggagatgcgggacaggaggttcagcgcagggcgggagctgcggcaggggctgaaccgcgagcggctgctgcgcgaggaggactttgagcccgacgcgcggacggggatcagccccgcgcgcgcgcacgtggcggccgccgacctggtgacggcgtacgagcagacggtgaaccaggagatcaacttccaaaagagtttcaacaaccacgtgcgcacgctggtggcgcgcgaggaggtgaccatcgggctgatgcacctgtgggactttgtaagcgcgctggtgcagaaccccaacagcaagcctctgacggcgcagctgttcctgatagtgcagcacagcagggacaacgaggcgtttagggacgcgctgctgaacatcaccgagcccgagggtcggtggctgctggacctgattaacatcctgcagagcatagtggtgcaggagcgcagcctgagcctggccgacaaggtggcggccatcaactactcgatgctgagcctgggcaagttttacgcgcgcaagatctaccagacgccgtacgtgcccatagacaaggaggtgaagatcgacggtttttacatgcgcatggcgctgaaggtgctcaccctgagcgacgacctgggcgtgtaccgcaacgagcgcatccacaaggccgtgagcgtgagccggcggcgcgagctgagcgaccgcgagctgatgcacagcctgcagcgggcgctggcgggcgccggcagcggcgacagggaggcggagtcctacttcgatgcgggggcggacctgcgctgggcgcccagccggcgggccctggaggccgcgggggtccgcgaggactatgacgaggacggcgaggaggatgaggagtacgagctagaggagggcgagtacctggactaaaccgcgggtggtgtttccggtagatgcaagacccgaacgtggtggacccggcgctgcgggcggctctgcagagccagccgtccggccttaactcctcagacgactggcgacaggtcatggaccgcatcatgtcgctgacggcgcgtaacccggacgcgttccggcagcagccgcaggccaacaggctctccgccatcctggaggcggtggtgcctgcgcgctcgaaccccacgcacgagaaggtgctggccatagtgaacgcgctggccgagaacagggccatccgcccggacgaggccgggctggtgtacgacgcgctgctgcagcgcgtggcccgctacaacagcggcaacgtgcagaccaacctggaccggctggtgggggacgtgcgcgaggcggtggcgcagcgcgagcgcgcggatcggcagggcaacctgggctccatggtggcgctgaatgccttcctgagcacgcagccggccaacgtgccgcgggggcaggaagactacaccaactttgtgagcgcgctgcggctgatggtgaccgagaccccccagagcgaggtgtaccagtcgggcccggactacttcttccagaccagcagacagggcctgcagacggtgaacctgagccaggctttcaagaacctgcgggggctgtggggcgtgaaggcgcccaccggcgaccgggcgacggtgtccagcctgctgacgcccaactcgcgcctgctgctgctgctgatcgcgccgttcacggacagcggcagcgtgtcccgggacacctacctggggcacctgctgaccctgtaccgcgaggccatcgggcaggcgcaggtggacgagcacaccttccaggagatcaccagcgtgagccgcgcgctggggcaggaggacacgagcagcctggaggcgactctgaactacctgctgaccaaccggcggcagaagattccctcgctgcacagcctgacctccgaggaggagcgcatcttgcgctacgtgcagcagagcgtgagcctgaacctgatgcgcgacggggtgacgcccagcgtggcgctggacatgaccgcgcgcaacatggaaccgggcatgtacgccgcgcaccggccttacatcaaccgcctgatggactacctgcatcgcgcggcggccgtgaaccccgagtactttaccaacgccatcctgaacccgcactggctcccgccgcccgggttctacagcgggggcttcgaggtcccggagaccaacgatggcttcctgtgggacgacatggacgacagcgtgttctccccgcggccgcaggcgctggcggaagcgtccctgctgcgtcccaagaaggaggaggaggaggaggcgagtcgccgccgcggcagcagcggcgtggcttctctgtccgagctgggggcggcagccgccgcgcgccccgggtccctgggcggcagcccctttccgagcctggtggggtctctgcacagcgagcgcaccacccgccctcggctgctgggcgaggacgagtacctgaataactccctgctgcagccggtgcgggagaaaaacctgcctcccgccttccccaacaacgggatagagagcctggtggacaagatgagcagatggaagacctatgcgcaggagcacagggacgcgcctgcgctccggccgcccacgcggcgccagcgccacgaccggcagcgggggctggtgtgggatgacgaggactccgcggacgatagcagcgtgctggacctgggagggagcggcaacccgttcgcgcacctgcgcccccgcctggggaggatgttttaaaaaaaaaaaaaaaaagcaagaagcatgatgcaaaaattaaataaaactcaccaaggccatggcgaccgagcgttggtttcttgtgttcccttcagtatgcggcgcgcggcgatgtaccaggagggacctcctccctcttacgagagcgtggtgggcgcggcggcggcggcgccctcttctccctttgcgtcgcagctgctggagccgccgtacgtgcctccgcgctacctgcggcctacgggggggagaaacagcatccgttactcggagctggcgcccctgttcgacaccacccgggtgtacctggtggacaacaagtcggcggacgtggcctccctgaactaccagaacgaccacagcaattttttgaccacggtcatccagaacaatgactacagcccgagcgaggccagcacccagaccatcaatctggatgaccggtcgcactggggcggcgacctgaaaaccatcctgcacaccaacatgcccaacgtgaacgagttcatgttcaccaataagttcaaggcgcgggtgatggtgtcgcgctcgcacaccaaggaagaccgggtggagctgaagtacgagtgggtggagttcgagctgccagagggcaactactccgagaccatgaccattgacctgatgaacaacgcgatcgtggagcactatctgaaagtgggcaggcagaacggggtcctggagagcgacatcggggtcaagttcgacaccaggaacttccgcctggggctggaccccgtgaccgggctggttatgcccggggtgtacaccaacgaggccttccatcccgacatcatcctgctgcccggctgcggggtggacttcacttacagccgcctgagcaacctcctgggcatccgcaagcggcagcccttccaggagggcttcaggatcacctacgaggacctggaggggggcaacatccccgcgctcctcgatgtggaggcctaccaggatagcttgaaggaaaatgaggcgggacaggaggataccgcccccgccgcctccgccgccgccgagcagggcgaggatgctgctgacaccgcggccgcggacggggcagaggccgaccccgctatggtggtggaggctcccgagcaggaggaggacatgaatgacagtgcggtgcgcggagacaccttcgtcacccggggggaggaaaagcaagcggaggccgaggccgcggccgaggaaaagcaactggcggcagcagcggcggcggcggcgttggccgcggcggaggctgagtctgaggggaccaagcccgccaaggagcccgtgattaagcccctgaccgaagatagcaagaagcgcagttacaacctgctcaaggacagcaccaacaccgcgtaccgcagctggtacctggcctacaactacggcgacccgtcgacgggggtgcgctcctggaccctgctgtgcacgccggacgtgacctgcggctcggagcaggtgtactggtcgctgcccgacatgatgcaagaccccgtgaccttccgctccacgcggcaggtcagcaacttcccggtggtgggcgccgagctgctgcccgtgcactccaagagcttctacaacgaccaggccgtctactcccagctcatccgccagttcacctctctgacccacgtgttcaatcgctttcctgagaaccagattctggcgcgcccgcccgcccccaccatcaccaccgtcagtgaaaacgttcctgctctcacagatcacgggacgctaccgctgcgcaacagcatcggaggagtccagcgagtgaccgttactgacgccagacgccgcacctgcccctacgtttacaaggccttgggcatagtctcgccgcgcgtcctttccagccgcactttttgagcaacaccaccatcatgtccatcctgatctcacccagcaataactccggctggggactgctgcgcgcgcccagcaagatgttcggaggggcgaggaagcgttccgagcagcaccccgtgcgcgtgcgcgggcacttccgcgccccctggggagcgcacaaacgcggccgcgcggggcgcaccaccgtggacgacgccatcgactcggtggtggagcaggcgcgcaactacaggcccgcggtctctaccgtggacgcggccatccagaccgtggtgcggggcgcgcggcggtacgccaagctgaagagccgccggaagcgcgtggcccgccgccaccgccgccgacccggggccgccgccaaacgcgccgccgcggccctgcttcgccgggccaagcgcacgggccgccgcgccgccatgagggccgcgcgccgcttggccgccggcatcaccgccgccaccatggccccccgtacccgaagacgcgcggccgccgccgccgccgccgccatcagtgacatggccagcaggcgccggggcaacgtgtactgggtgcgcgactcggtgaccggcacgcgcgtgcccgtgcgcttccgccccccgcggacttgagatgatgtgaaaaaacaacactgagtctcctgctgttgtgtgtatcccagcggcggcggcgcgcgcagcgtcatgtccaagcgcaaaatcaaagaagagatgctccaggtcgtcgcgccggagatctatgggcccccgaagaaggaagagcaggattcgaagccccgcaagataaagcgggtcaaaaagaaaaagaaagatgatgacgatgccgatggggaggtggagttcctgcgcgccacggcgcccaggcgcccggtgcagtggaagggccggcgcgtaaagcgcgtcctgcgccccggcaccgcggtggtcttcacgcccggcgagcgctccacccggactttcaagcgcgtctatgacgaggtgtacggcgacgaagacctgctggagcaggccaacgagcgcttcggagagtttgcttacgggaagcgtcagcgggcgctggggaaggaggacctgctggcgctgccgctggaccagggcaaccccacccccagtctgaagcccgtgaccctgcagcaggtgctgccgagcagcgcaccctccgaggcgaagcggggtctgaagcgcgagggcggcgacctggcgcccaccgtgcagctcatggtgcccaagcggcagaggctggaggatgtgctggagaaaatgaaagtagaccccggtctgcagccggacatcagggtccgccccatcaagcaggtggcgccgggcctcggcgtgcagaccgtggacgtggtcatccccaccggcaactcccccgccgccgccaccactaccgctgcctccacggacatggagacacagaccgatcccgccgcagccgcagccgcagccgccgccgcgacctcctcggcggaggtgcagacggacccctggctgccgccggcgatgtcagctccccgcgcgcgtcgcgggcgcaggaagtacggcgccgccaacgcgctcctgcccgagtacgccttgcatccttccatcgcgcccacccccggctaccgaggctatacctaccgcccgcgaagagccaagggttccacccgccgtccccgccgacgcgccgccgccaccacccgccgccgccgccgcagacgccagcccgcactggctccagtctccgtgaggaaagtggcgcgcgacggacacaccctggtgctgcccagggcgcgctaccaccccagcatcgtttaaaagcctgttgtggttcttgcagatatggccctcacttgccgcctccgtttcccggtgccgggataccgaggaggaagatcgcgccgcaggaggggtctggccggccgcggcctgagcggaggcagccgccgcgcgcaccggcggcgacgcgccaccagccgacgcatgcgcggcggggtgctgcccctgttaatccccctgatcgccgcggcgatcggcgccgtgcccgggatcgcctccgtggccttgcaagcgtcccagaggcattgacagacttgcaaacttgcaaatatggaaaaaaaaaccccaataaaaaagtctagactctcacgctcgcttggtcctgtgactattttgtagaatggaagacatcaactttgcgtcgctggccccgcgtcacggctcgcgcccgttcctgggacactggaacgatatcggcaccagcaacatgagcggtggcgccttcagttggggctctctgtggagcggcattaaaagtatcgggtctgccgttaaaaattacggctcccgggcctggaacagcagcacgggccagatgttgagagacaagttgaaagagcagaacttccagcagaaggtggtggagggcctggcctccggcatcaacggggtggtggacctggccaaccaggccgtgcagaataagatcaacagcagactggacccccggccgccggtggaggaggtgccgccggcgctggagacggtgtcccccgatgggcgtggcgagaagcgcccgcggcccgatagggaagagaccactctggtcacgcagaccgatgagccgcccccgtatgaggaggccctgaagcaaggtctgcccaccacgcggcccatcgcgcccatggccaccggggtggtgggccgccacacccccgccacgctggacttgcctccgcccgccgatgtgccgcagcagcagaaggcggcacagccgggcccgcccgcgaccgcctcccgttcctccgccggtcctctgcgccgcgcggccagcggcccccgcgggggggtcgcgaggcacggcaactggcagagcacgctgaacagcatcgtgggtctgggggtgcggtccgtgaagcgccgccgatgctactgaatagcttagctaacgtgttgtatgtgtgtatgcgccctatgtcgccgccagaggagctgctgagtcgccgccgttcgcgcgcccaccaccaccgccactccgcccctcaagatggcgaccccatcgatgatgccgcagtggtcgtacatgcacatctcgggccaggacgcctcggagtacctgagccccgggctggtgcagttcgcccgcgccaccgagagctacttcagcctgagtaacaagtttaggaaccccacggtggcgcccacgcacgatgtgaccaccgaccggtctcagcgcctgacgctgcggttcattcccgtggaccgcgaggacaccgcgtactcgtacaaggcgcggttcaccctggccgtgggcgacaaccgcgtgctggacatggcctccacctactttgacatccgcggggtgctggaccggggtcccactttcaagccctactctggcaccgcctacaactccctggcccccaagggcgctcccaactcctgcgagtgggagcaagaggaaactcaggcagttgaagaagcagcagaagaggaagaagaagatgctgacggtcaagctgaggaagagcaagcagctaccaaaaagactcatgtatatgctcaggctcccctttctggcgaaaaaattagtaaagatggtctgcaaataggaacggacgctacagctacagaacaaaaacctatttatgcagaccctacattccagcccgaaccccaaatcggggagtcccagtggaatgaggcagatgctacagtcgccggcggtagagtgctaaagaaatctactcccatgaaaccatgctatggttcctatgcaagacccacaaatgctaatggaggtcagggtgtactaacggcaaatgcccagggacagctagaatctcaggttgaaatgcaattcttttcaacttctgaaaacgcccgtaacgaggctaacaacattcagcccaaattggtgctgtatagtgaggatgtgcacatggagaccccggatacgcacctttcttacaagcccgcaaaaagcgatgacaattcaaaaatcatgctgggtcagcagtccatgcccaacagacctaattacatcggcttcagagacaactttatcggcctcatgtattacaatagcactggcaacatgggagtgcttgcaggtcaggcctctcagttgaatgcagtggtggacttgcaagacagaaacacagaactgtcctaccagctcttgcttgattccatgggtgacagaaccagatacttttccatgtggaatcaggcagtggacagttatgacccagatgttagaattattgaaaatcatggaactgaagacgagctccccaactattgtttccctctgggtggcataggggtaactgacacttaccaggctgttaaaaccaacaatggcaataacgggggccaggtgacttggacaaaagatgaaacttttgcagatcgcaatgaaataggggtgggaaacaatttcgctatggagatcaacctcagtgccaacctgtggagaaacttcctgtactccaacgtggcgctgtacctaccagacaagcttaagtacaacccctccaatgtggacatctctgacaaccccaacacctacgattacatgaacaagcgagtggtggccccggggctggtggactgctacatcaacctgggcgcgcgctggtcgctggactacatggacaacgtcaaccccttcaaccaccaccgcaatgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggtaacgatctcagggtggacggggccagcatcaagttcgagagcatctgcctctacgccaccttcttccccatggcccacaacacggcctccacgctcgaggccatgctcaggaacgacaccaacgaccagtccttcaatgactacctctccgccgccaacatgctctaccccatacccgccaacgccaccaacgtccccatctccatcccctcgcgcaactgggcggccttccgcggctgggccttcacccgcctcaagaccaaggagaccccctccctgggctcgggattcgacccctactacacctactcgggctccattccctacctggacggcaccttctacctcaaccacactttcaagaaggtctcggtcaccttcgactcctcggtcagctggccgggcaacgaccgtctgctcacccccaacgagttcgagatcaagcgctcggtcgacggggagggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctatccgctcataggcaagaccgcggtcgacagcatcacccagaaaaagttcctctgcgaccgcaccctctggcgcatccccttctccagcaacttcatgtccatgggtgcgctctcggacctgggccagaacttgctctacgccaactccgcccacgccctcgacatgaccttcgaggtcgaccccatggacgagcccacccttctctatgttctgttcgaagtctttgacgtggtccgggtccaccagccgcaccgcggcgtcatcgagaccgtgtacctgcgtacgcccttctcggccggcaacgccaccacctaaagaagcaagccgcagtcatcgccgcctgcatgccgtcgggttccaccgagcaagagctcagggccatcgtcagagacctgggatgcgggccctattttttgggcaccttcgacaagcgcttccctggctttgtctccccacacaagctggcctgcgccatcgtcaacacggccggccgcgagaccgggggcgtgcactggctggccttcgcctggaacccgcgctccaaaacatgcttcctctttgaccccttcggcttttcggaccagcggctcaagcaaatctacgagttcgagtacgagggcttgctgcgtcgcagcgccatcgcctcctcgcccgaccgctgcgtcaccctcgaaaagtccacccagaccgtgcaggggcccgactcggccgcctgcggtctcttctgctgcatgtttctgcacgcctttgtgcactggcctcagagtcccatggaccgcaaccccaccatgaacttgctgacgggggtgcccaactccatgctccagagcccccaggtcgagcccaccctgcgccgcaaccaggagcagctctacagcttcctggagcgccactcgccttacttccgccgccacagcgcacagatcaggagggccacctccttctgccacttgcaagagatgcaagaagggtaataacgatgtacacactttttttctcaataaatggcatctttttatttatacaagctctctggggtattcatttcccaccaccacccgccgttgtcgccatctggctctatttagaaatcgaaagggttctgccgggagtcgccgtgcgccacgggcagggacacgttgcgatactggtagcgggtgccccacttgaactcgggcaccaccaggcgaggcagctcggggaagttttcgctccacaggctgcgggtcagcaccagcgcgttcatcaggtcgggcgccgagatcttgaagtcgcagttggggccgccgccctgcgcgcgcgagttgcggtacaccgggttgcagcactggaacaccaacagcgccgggtgcttcacgctggccagcacgctgcggtcggagatcagctcggcgtccaggtcctccgcgttgctcagcgcgaacggggtcatcttgggcacttgccgccccaggaagggcgcgtgccccggtttcgagttgcagtcgcagcgcagcgggatcagcaggtgcccgtgcccggactcggcgttggggtacagcgcgcgcatgaaggcctgcatctggcggaaggccatctgggccttggcgccctccgagaagaacatgccgcaggacttgcccgagaactggtttgcggggcagctggcgtcgtgcaggcagcagcgcgcgtcggtgttggcgatctgcaccacgttgcgcccccaccggttcttcacgatcttggccttggacgattgctccttcagcgcgcgctgcccgttctcgctggtcacatccatctcgatcacatgttccttgttcaccatgctgctgccgtgcagacacttcagctcgccctccgtctcggtgcagcggtgctgccacagcgcgcagcccgtgggctcgaaagacttgtaggtcacctccgcgaaggactgcaggtacccctgcaaaaagcggcccatcatggtcacgaaggtcttgttgctgctgaaggtcagctgcagcccgcggtgctcctcgttcagccaggtcttgcacacggccgccagcgcctccacctggtcgggcagcatcttgaagttcaccttcagctcattctccacgtggtacttgtccatcagcgtgcgcgccgcctccatgcccttctcccaggccgacaccagcggcaggctcacggggttcttcaccatcaccgtggccgccgcctccgccgcgctttcgctttccgccccgctgttctcttcctcttcctcctcttcctcgccgccgcccactcgcagcccccgcaccacggggtcgtcttcctgcaggcgctgcaccttgcgcttgccgttgcgcccctgcttgatgcgcacgggcgggttgctgaagcccaccatcaccagcgcggcctcttcttgctcgtcctcgctgtccagaatgacctccggggagggggggttggtcatcctcagtaccgaggcacgcttctttttcttcctgggggcgttcgccagctccgcggctgcggccgctgccgaggtcgaaggccgagggctgggcgtgcgcggcaccagcgcgtcctgcgagccgtcctcgtcctcctcggactcgagacggaggcgggcccgcttcttcgggggcgcgcggggcggcggaggcggcggcggcgacggagacggggacgagacatcgtccagggtgggtggacggcgggccgcgccgcgtccgcgctcgggggtggtctcgcgctggtcctcttcccgactggccatctcccactgctccttctcctataggcagaaagagatcatggagtctctcatgcgagtcgagaaggaggaggacagcctaaccgccccctctgagccctccaccaccgccgccaccaccgccaatgccgccgcggacgacgcgcccaccgagaccaccgccagtaccaccctccccagcgacgcacccccgctcgagaatgaagtgctgatcgagcaggacccgggttttgtgagcggagaggaggatgaggtggatgagaaggagaaggaggaggtcgccgcctcagtgccaaaagaggataaaaagcaagaccaggacgacgcagataaggatgagacagcagtcgggcgggggaacggaagccatgatgctgatgacggctacctagacgtgggagacgacgtgctgcttaagcacctgcaccgccagtgcgtcatcgtctgcgacgcgctgcaggagcgctgcgaagtgcccctggacgtggcggaggtcagccgcgcctacgagcggcacctcttcgcgccgcacgtgccccccaagcgccgggagaacggcacctgcgagcccaacccgcgtctcaacttctacccggtcttcgcggtacccgaggtgctggccacctaccacatctttttccaaaactgcaagatccccctctcctgccgcgccaaccgcacccgcgccgacaaaaccctgaccctgcggcagggcgcccacatacctgatatcgcctctctggaggaagtgcccaagatcttcgagggtctcggtcgcgacgagaaacgggcggcgaacgctctgcacggagacagcgaaaacgagagtcactcgggggtgctggtggagctcgagggcgacaacgcgcgcctggccgtactcaagcgcagcatagaggtcacccactttgcctacccggcgctcaacctgccccccaaggtcatgagtgtggtcatgggcgagctcatcatgcgccgcgcccagcccctggccgcggatgcaaacttgcaagagtcctccgaggaaggcctgcccgcggtcagcgacgagcagctggcgcgctggctggagacccgcgaccccgcgcagctggaggagcggcgcaagctcatgatggccgcggtgctggtcaccgtggagctcgagtgtctgcagcgcttcttcgcggaccccgagatgcagcgcaagctcgaggagaccctgcactacaccttccgccagggctacgtgcgccaggcctgcaagatctccaacgtggagctctgcaacctggtctcctacctgggcatcctgcacgagaaccgcctcgggcagaacgtcctgcactccaccctcaaaggggaggcgcgccgcgactacatccgcgactgcgcctacctcttcctctgctacacctggcagacggccatgggggtctggcagcagtgcctggaggagcgcaacctcaaggagctggaaaagctcctcaagcgcaccctcagggacctctggacgggcttcaacgagcgctcggtggccgccgcgctggcggacatcatctttcccgagcgcctgctcaagaccctgcagcagggcctgcccgacttcaccagccagagcatgctgcagaacttcaggactttcatcctggagcgctcgggcatcctgccggccacttgctgcgcgctgcccagcgacttcgtgcccatcaagtacagggagtgcccgccgccgctctggggccactgctacctcttccagctggccaactacctcgcctaccactcggacctcatggaagacgtgagcggcgagggcctgctcgagtgccactgccgctgcaacctctgcacgccccaccgctctctagtctgcaacccgcagctgctcagcgagagtcagattatcggtaccttcgagctgcagggtccctcgcctgacgagaagtccgcggctccagggctgaaactcactccggggctgtggacttccgcctacctacgcaaatttgtacctgaggactaccacgcccacgagatcaggttctacgaagaccaatcccgcccgcccaaggcggagctcaccgcctgcgtcatcacccaggggcacatcctgggccaattgcaagccatcaacaaagcccgccgagagttcttgctgaaaaagggtcggggggtgtacctggacccccagtccggcgaggagctaaacccgctacccccgccgccgccccagcagcgggaccttgcttcccaggatggcacccagaaagaagcagcagccgccgccgccgccgcagccatacatgcttctggaggaagaggaggaggactgggacagtcaggcagaggaggtttcggacgaggagcaggaggagatgatggaagactgggaggaggacagcagcctagacgaggaagcttcagaggccgaagaggtggcagacgcaacaccatcgccctcggtcgcagccccctcgccggggcccctgaaatcctccgaacccagcaccagcgctataacctccgctcctccggcgccggcgccacccgcccgcagacccaaccgtagatgggacaccacaggaaccggggtcggtaagtccaagtgcccgccgccgccaccgcagcagcagcagcagcagcgccagggctaccgctcgtggcgcgggcacaagaacgccatagtcgcctgcttgcaagactgcgggggcaacatctctttcgcccgccgcttcctgctattccaccacggggtcgcctttccccgcaatgtcctgcattactaccgtcatctctacagcccctactgcagcggcgacccagaggcggcagcggcagccacagcggcgaccaccacctaggaagatatcctccgcgggcaagacagcggcagcagcggccaggagacccgcggcagcagcggcgggagcggtgggcgcactgcgcctctcgcccaacgaacccctctcgacccgggagctcagacacaggatcttccccactttgtatgccatcttccaacagagcagaggccaggagcaggagctgaaaataaaaaacagatctctgcgctccctcacccgcagctgtctgtatcacaaaagcgaagatcagcttcggcgcacgctggaggacgcggaggcactcttcagcaaatactgcgcgctcactcttaaagactagctccgcgcccttctcgaatttaggcgggagaaaactacgtcatcgccggccgccgcccagcccgcccagccgagatgagcaaagagattcccacgccatacatgtggagctaccagccgcagatgggactcgcggcgggagcggcccaggactactccacccgcatgaactacatgagcgcgggaccccacatgatctcacaggtcaacgggatccgcgcccagcgaaaccaaatactgctggaacaggcggccatcaccgccacgccccgccataatctcaacccccgaaattggcccgccgccctcgtgtaccaggaaaccccctccgccaccaccgtactacttccgcgtgacgcccaggccgaagtccagatgactaactcaggggcgcagctcgcgggcggctttcgtcacggggcgcggccgctccgaccaggtataagacacctgatgatcagaggccgaggtatccagctcaacgacgagtcggtgagctcttcgctcggtctccgtccggacggaactttccagctcgccggatccggccgctcttcgttcacgccccgccaggcgtacctgactctgcagacctcgtcctcggagccccgctccggcggcatcggaaccctccagttcgtggaggagttcgtgccctcggtctacttcaaccccttctcgggacctcccggacgctaccccgaccagttcattccgaactttgacgcggtgaaggactcggcggacggctacgactgaatgtcaggtgtcgaggcagagcagcttcgcctgagacacctcgagcactgccgccgccacaagtgcttcgcccgcggttctggtgagttctgctactttcagctacccgaggagcataccgaggggccggcgcacggcgtccgcctgaccacccagggcgaggttacctgttccctcatccgggagtttaccctccgtcccctgctagtggagcgggagcggggtccctgtgtcctaactatcgcctgcaactgccctaaccctggattacatcaagatctttgctgtcatctctgtgctgagtttaataaacgctgagatcagaatctactggggctcctgtcgccatcctgtgaacgccaccgtcttcacccaccccgaccaggcccaggcgaacctcacctgcggtctgcatcggagggccaagaagtacctcacctggtacttcaacggcaccccctttgtggtttacaacagcttcgacggggacggagtctccctgaaagaccagctctccggtctcagctactccatccacaagaacaccaccctccaactcttccctccctacctgccgggaacctacgagtgcgtcaccggccgctgcacccacctcacccgcctgatcgtaaaccagagctttccgggaacagataactccctcttccccagaacaggaggtgagctcaggaaactccccggggaccagggcggagacgtaccttcgacccttgtggggttaggattttttattaccgggttgctggctcttttaatcaaagtttccttgagatttgttctttccttctacgtgtatgaacacctcaacctccaataactctaccctttcttcggaatcaggtgacttctctgaaatcgggcttggtgtgctgcttactctgttgatttttttccttatcatactcagccttctgtgcctcaggctcgccgcctgctgcgcacacatctatatctactgctggttgctcaagtgcaggggtcgccacccaagatgaacaggtacatggtcctatcgatcctaggcctgctggccctggcggcctgcagcgccgccaaaaaagagattacctttgaggagcccgcttgcaatgtaactttcaagcccgagggtgaccaatgcaccaccctcgtcaaatgcgttaccaatcatgagaggctgcgcatcgactacaaaaacaaaactggccagtttgcggtctatagtgtgtttacgcccggagacccctctaactactctgtcaccgtcttccagggcggacagtctaagatattcaattacactttccctttttatgagttatgcgatgcggtcatgtacatgtcaaaacagtacaacctgtggcctccctctccccaggcgtgtgtggaaaatactgggtcttactgctgtatggctttcgcaatcactacgctcgctctaatctgcacggtgctatacataaaattcaggcagaggcgaatctttatcgatgaaaagaaaatgccttgatcgctaacaccggctttctatctgcagaatgaatgcaatcacctccctactaatcaccaccaccctccttgcgattgcccatgggttgacacgaatcgaagtgccagtggggtccaatgtcaccatggtgggccccgccggcaattccaccctcatgtgggaaaaatttgtccgcaatcaatgggttcatttctgctctaaccgaatcagtatcaagcccagagccatctgcgatgggcaaaatctaactctgatcaatgtgcaaatgatggatgctgggtactattacgggcagcggggagaaatcattaattactggcgaccccacaaggactacatgctgcatgtagtcgaggcacttcccactaccacccccactaccacctctcccaccaccaccaccactactactactactactactactactactactaccactaccgctgcccgccatacccgcaaaagcaccatgattagcacaaagccccctcgtgctcactcccacgccggcgggcccatcggtgcgacctcagaaaccaccgagctttgcttctgccaatgcactaacgccagcgctcatgaactgttcgacctggagaatgaggatgtccagcagagctccgcttgcctgacccaggaggctgtggagcccgttgccctgaagcagatcggtgattcaataattgactcttcttcttttgccactcccgaataccctcccgattctactttccacatcacgggtaccaaagaccctaacctctctttctacctgatgctgctgctctgtatctctgtggtctcttccgcgctgatgttactggggatgttctgctgcctgatctgccgcagaaagagaaaagctcgctctcagggccaaccactgatgcccttcccctaccccccggattttgcagataacaagatatgagctcgctgctgacactaaccgctttactagcctgcgctctaacccttgtcgcttgcgactcgagattccacaatgtcacagctgtggcaggagaaaatgttactttcaactccacggccgatacccagtggtcgtggagtggctcaggtagctacttaactatctgcaatagctccacttcccccggcatatccccaaccaagtaccaatgcaatgccagcctgttcaccctcatcaacgcttccaccctggacaatggactctatgtaggctatgtaccctttggtgggcaaggaaagacccacgcttacaacctggaagttcgccagcccagaaccactacccaagcttctcccaccaccaccaccaccaccaccatcaccagcagcagcagcagcagcagccacagcagcagcagcagattattgactttggttttggccagctcatctgccgctacccaggccatctacagctctgtgcccgaaaccactcagatccaccgcccagaaacgaccaccgccaccaccctacacacctccagcgatcagatgccgaccaacatcacccccttggctcttcaaatgggacttacaagccccactccaaaaccagtggatgcggccgaggtctccgccctcgtcaatgactgggcggggctgggaatgtggtggttcgccataggcatgatggcgctctgcctgcttctgctctggctcatctgctgcctccaccgcaggcgagccagaccccccatctatagacccatcattgtcctgaaccccgataatgatgggatccatagattggatggcctgaaaaacctacttttttcttttacagtatgataaattgagacatgcctcgcattttcttgtacatgttccttctcccaccttttctggggtgttctacgctggccgctgtgtctcacctggaggtagactgcctctcacccttcactgtctacctgctttacggattggtcaccctcactctcatctgcagcctaatcacagtaatcatcgccttcatccagtgcattgattacatctgtgtgcgcctcgcatacttcagacaccacccgcagtaccgagacaggaacattgcccaacttctaagactgctctaatcatgcataagactgtgatctgccttctgatcctctgcatcctgcccaccctcacctcctgccagtacaccacaaaatctccgcgcaaaagacatgcctcctgccgcttcacccaactgtggaatatacccaaatgctacaacgaaaagagcgagctctccgaagcttggctgtatggggtcatctgtgtcttagttttctgcagcactgtctttgccctcataatctacccctactttgatttgggatggaacgcgatcgatgccatgaattaccccacctttcccgcacccgagataattccactgcgacaagttgtacccgttgtcgttaatcaacgccccccatcccctacgcccactgaaatcagctactttaacctaacaggcggagatgactgacgccctagatctagaaatggacggcatcagtaccgagcagcgtctcctagagaggcgcaggcaggcggctgagcaagagcgcctcaatcaggagctccgagatctcgttaacctgcaccagtgcaaaagaggcatcttttgtctggtaaagcaggccaaagtcacctacgagaagaccggcaacagccaccgcctcagttacaaattgcccacccagcgccagaagctggtgctcatggtgggtgagaatcccatcaccgtcacccagcactcggtagagaccgaggggtgtctgcactccccctgtcggggtccagaagacctctgcaccctggtaaagaccctgtgcggtctcagagatttagtcccctttaactaatcaaacactggaatcaataaaaagaatcacttacttaaaatcagacagcaggtctctgtccagtttattcagcagcacctccttcccctcctcccaactctggtactccaaacgccttctggcggcaaacttcctccacaccctgaagggaatgtcagattcttgctcctgtccctccgcacccactatcttcatgttgttgcagatgaagcgcaccaaaacgtctgacgagagcttcaaccccgtgtacccctatgacacggaaagcggccctccctccgtccctttcctcacccctcccttcgtgtctcccgatggattccaagaaagtccccccggggtcctgtctctgaacctggccgagcccctggtcacttcccacggcatgctcgccctgaaaatgggaagtggcctctccctggacgacgctggcaacctcacctctcaagatatcaccaccgctagccctcccctcaaaaaaaccaagaccaacctcagcctagaaacctcatcccccctaactgtgagcacctcaggcgccctcaccgtagcagccgccgctcccctggcggtggccggcacctccctcaccatgcaatcagaggcccccctgacagtacaggatgcaaaactcaccctggccaccaaaggccccctgaccgtgtctgaaggcaaactggccttgcaaacatcggccccgctgacggccgctgacagcagcaccctcacagtcagtgccacaccaccccttagcacaagcaatggcagcttgggtattgacatgcaagcccccatttacaccaccaatggaaaactaggacttaactttggcgctcccctgcatgtggtagacagcctaaatgcactgactgtagttactggccaaggtcttacgataaacggaacagccctacaaactagagtctcaggtgccctcaactatgacacatcaggaaacctagaattgagagctgcagggggtatgcgagttgatgcaaatggtcaacttatccttgatgtagcttacccatttgatgcacaaaacaatctcagccttaggcttggacagggacccctgtttgttaactctgcccacaacttggatgttaactacaacagaggcctctacctgttcacatctggaaataccaaaaagctagaagttaatatcaaaacagccaagggtctcatttatgatgacactgctatagcaatcaatgcgggtgatgggctacagtttgactcaggctcagatacaaatccattaaaaactaaacttggattaggactggattatgactccagcagagccataattgctaaactgggaactggcctaagctttgacaacacaggtgccatcacagtaggcaacaaaaatgatgacaagcttaccttgtggaccacaccagacccatcccctaactgtagaatctattcagagaaagatgctaaattcacacttgttttgactaaatgcggcagtcaggtgttggccagcgtttctgttttatctgtaaaaggtagccttgcgcccatcagtggcacagtaactagtgctcagattgtcctcagatttgatgaaaatggagttctactaagcaattcttcccttgaccctcaatactggaactacagaaaaggtgaccttacagagggcactgcatataccaacgcagtgggatttatgcccaacctcacagcatacccaaaaacacagagccaaactgctaaaagcaacattgtaagtcaggtttacttgaatggggacaaatccaaacccatgaccctcaccattaccctcaatggaactaatgaaacaggagatgccacagtaagcacttactccatgtcattctcatggaactggaatggaagtaattacattaatgaaacgttccaaaccaactccttcaccttctcctacatcgcccaagaataaaaagcatgacgctgttgatttgattcaatgtgtttctgttttattttcaagcacaacaaaatcattcaagtcattcttccatcttagcttaatagacacagtagcttaatagacccagtagtgcaaagccccattctagcttataactagtggagaagtactcgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagtcttagatctctcaacgcagcaccagcaccaacacttcgcagtgtaaaaggccaagtgccgagagagtatatataggaataaaaagtgacgtaaacgggcaaagtccaaaaaacgcccagaaaaaccgcacgcgaacctacgccccgaaacgaaagccaaaaaacactagacactcccttccggcgtcaacttccgctttcccacgctacgtcacttgccccagtcaaacaaactacatatcccgaacttccaagtcgccacgcccaaaacaccgcctacacctccccgcccgccggcccgcccccaaacccgcctcccgccccgcgccccgccccgcgccgcccatctcattatcatattggcttcaatccaaaataaggtatattattgatgatg

SEQ ID NO: 12 - DNA, 1109 bp, Artificial
  synthetic polynucleotide
ggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcgggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgctccctatcagtgatagagatctccctatcagtgatagagatcgtcgacgagctcgcggcgggcgggagtcgctgcgcgctgccttcgccccgtgccccgctccgccgccgcctcgcgccgcccgccccggctctgactgaccgcgttactaaaacaggtaagtccggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgatgcctctactaaccatgttcatgttttctttttttttctacaggtcctgggtgacgaacag

SEQ ID NO: 13 - DNA, 33 bp, Artificial
  primer
atacggactagtggagaagtactcgcctacatg

SEQ ID NO: 14 - DNA, 36 bp, Artificial
  primer
atacggaagatctaagacttcaggaaatatgactac

SEQ ID NO: 15 - DNA, 46 bp, Artificial
  primer
attcagtgtacaggcgcgccaaagcatgacgctgttgatttgattc

SEQ ID NO: 16 - DNA, 35 bp, Artificial
  primer
actaggactagttataagctagaatggggctttgc

SEQ ID NO: 17 - DNA, 79 bp, Artificial
  primer
ttaatagacacagtagcttaatagacccagtagtgcaaagccccattctagcttataacccctatttgtttatttttct

SEQ ID NO: 18 - DNA, 93 bp, Artificial
  primer
atatatactctctcggcacttggccttttacactgcgaagtgttggtgctggtgctgcgttgagagatctttatttgttaactgttaattgtc

SEQ ID NO: 19 - DNA, 23 bp, Artificial
  primer
ttaatagacacagtagcttaata

SEQ ID NO: 20 - DNA, 20 bp, Artificial
  primer
ggaagggagtgtctagtgtt

SEQ ID NO: 21 - DNA, 25 bp, Artificial
  primer
caatgggcgtggatagcggtttgac

SEQ ID NO: 22 - DNA, 19 bp, Artificial
  primer
cagcatgcctgctattgtc

SEQ ID NO: 23 - DNA, 29 bp, Artificial
  primer
catctacgtattagtcatcgctattacca

SEQ ID NO: 24 - DNA, 21 bp, Artificial
  primer
gacttggaaatccccgtgagt

SEQ ID NO: 25 - DNA, 25 bp, Artificial
  primer
acatcaatgggcgtggatagcggtt

SEQ ID NO: 26 - DNA, 592 bp, Artificial
  synthetic polynucleotide
taatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcct

SEQ ID NO: 27 - protein, 543 aa, Simian adenovirus
MKRTKTSDESFNPVYPYDTESGPPSVPFLTPPFVSPDGFQESPPGVLSLNLAEPLVTSHGMLALKMGSGLSLDDAGNLTSQDITTASPPLKKTKTNLSLETSSPLTVSTSGALTVAAAAPLAVAGTSLTMQSEAPLTVQDAKLTLATKGPLTVSEGKLALQTSAPLTAADSSTLTVSATPPINVSSGSLGLDMEDPMYTHDGKLGIRIGGPLRVVDSLHTLTVVTGNGLTVDNNALQTRVTGALGYDTSGNLQLRAAGGMRIDANGQLILNVAYPFDAQNNLSLRLGQGPLYINTDHNLDLNCNRGLTTTTTNNTKKLETKISSGLDYDTNGAVIIKLGTGLSFDNTGALTVGNTGDDKLTLWTTPDPSPNCRIHSDKDCKFTLVLTKCGSQILASVAALAVSGNLASITGTVASVTIFLRFDQNGVLMENSSLDRQYWNFRNGNSTNAAPYTNAVGFMPNLAAYPKTQSQTAKNNIVSQVYLNGDKSKPMTLTITLNGTNESSETSQVSHYSMSFTWAWESGQYATETFATNSFTFSYIAEQ

SEQ ID NO: 28 - protein, 541 aa, Simian adenovirus
MKRAKTSDETFNPVYPYDTENGPPSVPFLTPPFVSPDGFQESPPGVLSLRLSEPLVTSHGMLALKMGNGLSLDDAGNLTSQDVTTVTPPLKKTKTNLSLQTSAPLTVSSGSLTVAAAAPLAVAGTSLTMQSQAPLTVQDAKLGLATQGPLTVSEGKLTLQTSAPLTAADSSTLTVGTTPPISVSSGSLGLDMEDPMYTHDGKLGIRIGGPLQVVDSLHTLTVVTGNGITVANNALQTKVAGALGYDSSGNLELRAAGGMRINTGGQLILDVAYPFDAQNNLSLRLGQGPLYVNTNHNLDLNCNRGLTTTTSSNTTKLETKIDSGLDYNANGAIIAKLGTGLTFDNTGAITVGNTGDDKLTLWTTPDPSPNCRIHADKDKFTLVLTKCGSQILASVAALAVSGNLSSMTGTVSSVTIFLRFDQNGVLMENSSLDKEYWNFRNGNSTNATPYTNAVGFMPNLSAYPKTQSQTAKNNIVSEVYLHGDKSKPMILTITLNGTNESSETSQVSHYSMSFTWSWDSGKYATETFATNSFTFSYIAEQ

SEQ ID NO: 29 - protein, 543 aa, Simian adenovirus
MKRTKTSDESFNPVYPYDTESGPPSVPFLTPPFVSPDGFQESPPGVLSLNLAEPLVTSHGMLALKMGSGLSLDDAGNLTSQDITSTTPPLKKTKTNLSLETSSPLTVSTSGALTVAAAAPLAVAGTSLTMQSEAPLAVQDAKLTLATKGPLTVSEGKLALQTSAPLTAADSSTLTVSSTPPISVSSGSLGLDMEDPMYTHDGKLGIRIGGPLRVVDSLHTLTVVTGNGLTVDNNALQTRVTGALGYDTSGNLQLRAAGGMRIDANGQLILDVAYPFDAQNNLSLRLGQGPLYVNTDHNLDLNCNRGLTTTTTNNTKKLETKISSGLDYDTNGAVIIKLGTGLSFDNTGALTVGNTGDDKLTLWTTPDPSPNCRIHSDKDCKFTLVLTKCGSQILASVAALAVSGNLASITGTVASVTIFLRFDQNGVLMENSSLDKQYWNFRNGNSTNAAPYTNAVGFMPNLAAYPKTQSQTAKNNIVSQVYLNGDKSKPMTLTITLNGTNESSETSQVSHYSMSFTWAWESGQYATETFATNSFTFSYIAEQ

SEQ ID NO: 30 - protein, 543 aa, Simian adenovirus
MKRTKTSDKSFNPVYPYDTENGPPSVPFLTPPFVSPDGFQESPPGVLSLNLAEPLVTSHGMLALKMGSGLSLDDAGNLTSQDVTTTTPPLKKTKTNLSLETSAPLTVSTSGALTLAAAAPLAVAGTSLTMQSEAPLTVQDAKLTLATKGPLTVSEGKLALQTSAPLTAADSSTLTVSATPPISVSSGSLGLDMEDPMYTHDGKLGIRIGGPLRVVDSLHTLTVVTGNGIAVDNNALQTRVTGALGYDTSGNLQLRAAGGMRIDANGQLILDVAYPFDAQNNLSLRLGQGPLYVNTDHNLDLNCNRGLTTTTTNNTKKLETKIGSGLDYDTNGAVIIKLGTGVSFDSTGALSVGNTGDDKLTLWTTPDPSPNCRIHSDKDCKFTLVLTKCGSQILASVAALAVSGNLASITGTVSSVTIFLRFDQNGVLMENSSLDKQYWNFRNGNSTNATPYTNAVGFMPNLAAYPKTQSQTAKNNIVSQVYLNGDKSKPMTLTITLNGTNESSETSQVSHYSMSFTWAWESGQYATETFATNSFTFSYIAEQ

SEQ ID NO: 31 - protein, 543 aa, Simian adenovirus
MKRTKTSDESFNPVYPYDTENGPPSVPFLTPPFVSPDGFQESPPGVLSLNLAEPLVTSHGMLALKMGSGLSLDDAGNLTSQDVTTTTPPLKKTKTNLSLETSAPLTVSTSGALTLAAAAPLAVAGTSLTMQSEAPLTVQDAKLTLATKGPLTVSEGKLALQTSAPLTAADSSTLTVSATPPINVSSGSLGLDMENPMYTHDGKLGIRIGGPLRVVDSLHTLTVVTGNGIAVDNNALQTRVTGALGYDTSGNLQLRAAGGMRIDANGQLILDVAYPFDAQNNLSLRLGQGPLYVNTDHNLDLNCNRGLTTTTTNNTKKLETKIGSGLDYDTNGAVIIKLGTGVSFDSTGALSVGNTGDDKLTLWTTPDPSPNCRIHSDKDCKFTLVLTKCGSQILASVAALAVSGNLASITGTVSSVTIFLRFDQNGVLMENSSLDKQYWNFRNGNSTNATPYTNAVGFMPNLAAYPKTQSQTAKNNIVSQVYLNGDKSKPMILTITLNGTNESSETSQVSHYSMSFTWAWESGQYATETFATNSFTFSYIAEQ

SEQ ID NO: 32 - protein, 578 aa, Simian adenovirus
MKRTKTSDESFNPVYPYDTENGPPSVPFLTPPFVSPDGFQESPPGVLSLNLAEPLVTSHGMLALKMGSGLSLDDAGNLTSQDVTTTTPPLKKTKTNLSLETSAPLTVSTSGALTLAAAVPLAVAGTSLTMQSEAPLTVQDAKLTLATKGPLTVSEGKLALQTSAPLTAADSSTLTISATPPLSTSNGSLGIDMQAPIYTTNGKLGLNFGAPLHVVDSLNALTVVTGQGLTINGTALQTRVSGALNYDSSGNLELRAAGGMRVDANGKLILDVAYPFDAQNNLSLRLGQGPLFVNSAHNLDVNYNRGLYLFTSGNTKKLEVNIKTAKGLIYDDTAIAINPGDGLEFGSGSDTNPLKTKLGLGLEYDSSRAIIAKLGTGLSFDNTGAITVGNKNDDKLTLWTTPDPSPNCRIYSEKDAKFTLVLTKCGSQVLASVSVLSVKGSLAPISGTVTSAQIILRFDENGVLLSNSSLDPQYWNYRKGDLTEGTAYTNAVGFMPNLTAYPKTQSQTAKSNIVSQVYLNGDKSKPMILTITLNGTNETGDATVSTYSMSFSWNWNGSNYINETFQTNSFTFSYIAQE

SEQ ID NO: 33 - protein, 578 aa, Simian adenovirus; identical to SEQ ID NO: 1

SEQ ID NO: 34 - protein, 578 aa, Simian adenovirus; identical to SEQ ID NO: 1

SEQ ID NO: 35 - protein, 577 aa, Simian adenovirus
MKRAKTSDETFNPVYPYDTENGPPSVPFLTPPFVSPDGFQESPPGVLSLRLSEPLVTSHGMLALKMGNGLSLDDAGNLTSQDVTTVTPPLKKTKTNLSLQTSAPLTVSSGSLTVAAAAPLAVAGTSLTMQSQAPLTVQDAKLGLATQGPLTVSEGKLTLQTSAPLTAADSSTLTVSATPPLSTSNGSLSIDMQAPIYTTNGKLALNIGAPLHVVDTLNALTVVTGQGLTINGRALQTRVTGALSYDTEGNIQLQAGGGMRIDNNGQLILNVAYPFDAQNNLSLRLGQGPLIVNSAHNLDLNLNRGLYLFTSGNTKKLEVNIKTAKGLFYDGTAIAINAGDGLQFGSGSDTNPLQTKLGLGLEYDSNKAIITKLGTGLSFDNTGAITVGNKNDDKLTLWTTPDPSPNCRINSEKDAKLTLVLTKCGSQVLASVSVLSVKGSLAPISGTVTSAQIVLRFDENGVLLSNSSLDPQYWNYRKGDSTEGTAYTNAVGFMPNLTAYPKTQSQTAKSNIVSQVYLNGDKTKPMTLTITLNGTNETGDATVSTYSMSFSWNWNGSNYINDTFQTNSFTFSYIAQE

SEQ ID NO: 36 - protein, 577 aa, Simian adenovirus; identical to SEQ ID NO: 35

SEQ ID NO: 37 - protein, 1145 aa, Artificial
  synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLNDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNRKRRAPVKQTLNFDLLKLAGDVESNPGPMALSKVKLNDTLNKDQLLSSSKYTIQRSTGDSIDTPNYDVQKHINKLCGMLLITEDANHKFTGLIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVELGGGGSGGGGMSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKESTVSDTNDHAKNNDTT

SEQ ID NO: 38 - DNA, 1502 bp, Artificial
  synthetic polynucleotide
atgggtgctagggcttctgtgctgtctggtggtgagctggacaagtgggagaagatcaggctgaggcctggtggcaagaagaagtacaagctaaagcacattgtgtgggcctccagggagctggagaggtttgctgtgaaccctggcctgctggagacctctgaggggtgcaggcagatcctgggccagctccagccctccctgcaaacaggctctgaggagctgaggtccctgtacaacacagtggctaccctgtactgtgtgcaccagaagattgatgtgaaggacaccaaggaggccctggagaagattgaggaggagcagaacaagtccaagaagaaggcccagcaggctgctgctggcacaggcaactccagccaggtgtcccagaactaccccattgtgcagaacctccagggccagatggtgcaccaggccatctccccccggaccctgaatgcctgggtgaaggtggtggaggagaggccttctcccctgaggtgatccccatgttctctgccctgtctgagggtgccaccccccaggacctgaacaccatgctgaacacagtggggggccatcaggctgccatgcagatgctgaaggagaccatcaatgaggaggctgctgagtgggacaggctgcatcctgtgcacgctggccccattgcccccggccagatgagggagcccaggggctctgacattgctggcaccacctccaccctccaggagcagattggctggatgaccaacaacccccccatccctgtgggggaaatctacaagaggtggatcatcctgggcctgaacaagattgtgaggatgtactcccccacctccatcctggacatcaggcagggccccaaggagcccttcagggactatgtggacaggttctacaagaccctgagggctgagcaggcctcccaggaggtgaagaactggatgacagagaccctgctggtgcagaatgccaaccctgactgcaagaccatcctgaaggccctgggccctgctgccaccctggaggagatgatgacagcctgccagggggtggggggccctggtcacaaggccagggtgctggctgaggccatgtcccaggtgaccaactccgccaccatcatgatgcagaggggcaacttcaggaaccagaggaagacagtgaagtgcttcaactgtggcaaggtgggccacattgccaagaactgtagggcccccaggaagaagggctgctggaagtgtggcaaggagggccaccagatgaaggactgcaatgagaggcaggccaacttcctgggcaaaatctggccctcccacaagggcaggcctggcaacttcctccagtccaggcctgagcccacagcccctcccgaggagtccttcaggtttggggaggagaagaccacccccagccagaagcaggagcccattgacaaggagctgtaccccctggcctccctgaggtccctgtttggcaacgacccctcctcccagtaa

SEQ ID NO: 39 - protein, 649 aa, human papilloma virus
MADPAGTNGEEGTGCNGWFYVEAVVEKKTGDAISDDENENDSDTGEDLVDFIVNDNDYLTQAETETAHALFTAQEAKQHRDAVQVLKRKYLVSPLSDISGCVDNNISPRLKAICIEKQSRAAKRRLFESEDSGYGNTEVETQQMLQVEGRHETETPCSQYSGGSGGGCSQYSSGSGGEGVSERHTICQTPLTNILNVLKTSNAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTGKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLHEDEDKENDGDSLPTFKCVSGQNTNTL

SEQ ID NO: 40 - protein, 365 aa, human papilloma virus
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIKKHGYTVEVQFDGDICNTMHYTNWTHIYICEEASVTVVEGQVDYYGLYYVHEGIRTYFVQFKDDAEKYSKNKVWEVHAGGQVILCPTSVFSSNEVSSPEIIRQHLANHPAATHTKAVALGTEETQTTIQRPRSEPDTGNPCHTTKLLHRDSVDSAPILTAFNSSHKGRINCNSNTTPIVHLKGDANTLKCLRYRFKKHCTLYTAVSSTWHWTGHNVKHKSAIVTLTYDSEWQRDQFLSQVKIPKTITVSTGFMSI

SEQ ID NO: 41 - protein, 158 aa, human papilloma virus
MHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQL

SEQ ID NO: 42 - protein, 98 aa, human papilloma virus
MHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 43 - protein, 489 aa, artificial
  synthetic polypeptide
GCNGWFYVEAVVEKKTGDAISDDENENDSDTGEDLVDFIVNDNDYLTQAETETAHALFTAQEAKQHRDAVQVLKRKYFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTGKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSL

SEQ ID NO: 44 - protein, 305 aa, artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIKKHGYTVEVQFDGDICNTMHYTNWTHIYGQVDYYGLYYVHEGIRTYFVQFKDDAEKYSKNKVWEVHAGGQVILCPTSVFSSNEVSSPEIDSVDSAPILTAFNSSHKGRINCNSNTTPIVHLKGDANTLKCLRYRFKKHCTLYTAVSSTWHWTGHNVKHKSAIVTLTYDSEWQRDQFLSQVKIPKTITVSTGFMSI

SEQ ID NO: 45 - protein, 140 aa, artificial
  synthetic polypeptide
MFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCC

SEQ ID NO: 46 - DNA, 72 bp, artificial
  linker
gcccctgtgaagcagaccctgaacttcgacctgctgaagctggccggcgacgtggagagcaatcccggccct

SEQ ID NO: 47 - protein, 24 aa, artificial
  linker
APVKQTLNFDLLKLAGDVESNPGP

SEQ ID NO: 48 - protein, 5 aa, artificial
  linker
GGGGG

SEQ ID NO: 49 - protein, 1172 aa, artificial
  synthetic polypeptide
MADPAGTNGEEGTGCNGWFYVEAVVEKKTGDAISDDENENDSDTGEDLVDFIVNDNDYLTQAETETAHALFTAQEAKQHRDAVQVLKRKYLVSPLSDISGCVDNNISPRLKAICIEKQSRAAKRRLFESEDSGYGNTEVETQQMLQVEGRHETETPCSQYSGGSGGGCSQYSSGSGGEGVSERHTICQTPLTNILNVLKTSNAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTGKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLHEDEDKENDGDSLPTFKCVSGQNTNTLMETLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIKKHGYTVEVQFDGDICNTMHYTNWTHIYICEEASVTVVEGQVDYYGLYYVHEGIRTYFVQFKDDAEKYSKNKVWEVHAGGQVILCPTSVFSSNEVSSPEIIRQHLANHPAATHTKAVALGTEETQTTIQRPRSEPDTGNPCHTTKLLHRDSVDSAPILTAFNSSHKGRINCNSNTTPIVHLKGDANTLKCLRYRFKKHCTLYTAVSSTWHWTGHNVKHKSAIVTLTYDSEWQRDQFLSQVKIPKTITVSTGFMSIMHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQL

SEQ ID NO: 50 - protein, 935 aa, artificial
  synthetic polypeptide
MGCNGWFYVEAVVEKKTGDAISDDENENDSDTGEDLVDFIVNDNDYLTQAETETAHALFTAQEAKQHRDAVQVLKRKYFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTGKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLMETLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIKKHGYTVEVQFDGDICNTMHYTNWTHIYGQVDYYGLYYVHEGIRTYFVQFKDDAEKYSKNKVWEVHAGGQVILCPTSVFSSNEVSSPEIDSVDSAPILTAFNSSHKGRINCNSNTTPIVHLKGDANTLKCLRYRFKKHCTLYTAVSSTWHWTGHNVKHKSAIVTLTYDSEWQRDQFLSQVKIPKTITVSTGFMSIMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCC

SEQ ID NO: 51 - protein, 420 aa, artificial
  synthetic polypeptide
AKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTDKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSL

SEQ ID NO: 52 - protein, 420 aa, artificial
  synthetic polypeptide
KQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTDKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLDL

SEQ ID NO: 53 - protein, 288 aa, artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIAKHGYTVEVQFDGDICNTMHYTNWTHIYICEEASVTVVEGQVDYYGLYYVHEGIRTYFVQFKDDAEKYSKNKVWEVHAGGQVILCPTSVFSGGTGGSTTPIVHLKGDANTLKCLRYRFKKHCTLYTAVSSTWHWTGHNVKHKSAIVTLTYDSEWQRDQFLSQVKIPKTITVSTGFMSI

SEQ ID NO: 54 - protein, 292 aa, artificial
  synthetic polypeptide
MQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFAKGGQTVQVYFDGNKDNCMTYVAWDSVYYMTDAGTWDKTATCVSHRGLYYVKEGYNTFYIEFKSECEKYGNTGTWEVHFGNNVIDCNDSMCSGGTGGSTTPIIHLKGDRNSLKCLRYRLRKHSDHYRDISSTWHWTGAGNEKTGILTVTYHSETQRTKFLNTVAIPDSVQILVGYMTM

SEQ ID NO: 55 - protein, 284 aa, artificial
  synthetic polypeptide
METLCHRLNVCQEKILDCYELDSDKLVDQINYWTLLRYEAAMFYAARERNLRTINHQVVPATTVSKQKACQAIEMHMALQSLNKSDYNMEPWTMRETCYELWCVAPKQCFAKGGITVTVIFDGNKDNAMDYTSWKFIYIYDNDKWVKTNGNVDYTGIYYTVNSKKEYYVQFKDEAKIYGAQQWEVYMYGTVITCPEYVSSGGTGGSTAFIVHLKGDTNCLKCFRYRFTKHKGLYKNVSSTWHWTSNTKTGIVTIVFDSAHQRETFIKTIKVPPSVTLSLGIMTL

SEQ ID NO: 56 - protein, 140 aa, artificial
  synthetic polypeptide
DPQERPRKLPQLCTELQTTIHDIILECVYCKQQLLRREVYDFARRDLCIVYRDGNPYAVCDKCLKFYSKISEYRHYCYSLYGTTLEQQYNKPLCDLLIRRINCQKPLCPEEKQRHLDKKQRFHNIRGRWTGRCMSCCRSS

SEQ ID NO: 57 - protein, 140 aa, artificial
  synthetic polypeptide
DPTRRPYKLPDLCTELNTSLQDIEITCVYCKTVLELTEVFEFARKDLFVVYRDSIPHAACHKCIDFYSRIRELRHYSDSVYGDTLEKLTNTGLYNLLIRRLRCQKPLNPAEKLRHLNEKRRFHNIAGHYRGQCHSCCNRA

SEQ ID NO: 58 - protein, 140 aa, artificial
  synthetic polypeptide
DAEEKPRTLHDLCQALETSVHEIELKCVECKKTLQRSEVYDFVRADLRIVYRDGNPFAVCKVCLRLLSKISEYRHYNYSLYGDTLEQTLKKCLNEILIRRIICQRPLCPQEKKRHVDLNKRFHNISGRWTGRCAVCWRPR

SEQ ID NO: 59 - protein, 140 aa, artificial
  synthetic polypeptide
NPQERPRSLHHLSEVLEIPLIDLRLSCVYCKKELTRAEVYNFARTELKLVYRDDFPYAVCRVCLLFYSKVRKYRYYDYSVYGATLESITKKQLCDLLIRRYRCQSPLTPEEKQLHCDRKRRFHLIAHGWTGSCLGCWRQT

SEQ ID NO: 60 - protein, 140 aa, artificial
  synthetic polypeptide
NSEERPYKLQALCDEVNISIHDINLDCVFCQRGLYRSEVYDFARSDLCIVYRKDKPYGVCQPCLKFYSKIREYRRYRQSVYGTTLENLTNKQLCNILIRRGKCQKPLCPLEKQKHVDEKKRFHQIAEQWTGRCTRCWRPS

SEQ ID NO: 61 - protein, 72 aa, artificial
  synthetic polypeptide
RAHYNIVTFCCKCDSTLRLCVQSTHVDIRTLEDLLMGTLGIVCPICSQKPTLHEYMLDLQPETTDLYGYQQL

SEQ ID NO: 62 - protein, 84 aa, artificial
  synthetic polypeptide
RHTMLCMCCKCEARIKLVVESSADDLRAFQQLFLNTLSFVCPWCASQQTLQDIVLHLEPQNEIPVDLLGHQQLSDSEEENDEID

SEQ ID NO: 63 - protein, 2615 aa, artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIAKHGYTVEVQFDGDICNTMHYTNWTHIYICEEASVTVVEGQVDYYGLYYVHEGIRTYFVQFKDDAEKYSKNKVWEVHAGGQVILCPTSVFSGGTGGSTTPIVHLKGDANTLKCLRYRFKKHCTLYTAVSSTWHWTGHNVKHKSAIVTLTYDSEWQRDQFLSQVKIPKTITVSTGFMSIGGGGGMQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFAKGGQTVQVYFDGNKDNCMTYVAWDSVYYMTDAGTWDKTATCVSHRGLYYVKEGYNTFYIEFKSECEKYGNTGTWEVHFGNNVIDCNDSMCSGGTGGSTTPIIHLKGDRNSLKCLRYRLRKHSDHYRDISSTWHWTGAGNEKTGILTVTYHSETQRTKFLNTVAIPDSVQILVGYMTMGGGGGMETLCHRLNVCQEKILDCYELDSDKLVDQINYWTLLRYEAAMFYAARERNLRTINHQVVPATTVSKQKACQAIEMHMALQSLNKSDYNMEPWTMRETCYELWCVAPKQCFAKGGITVTVIFDGNKDNAMDYTSWKFIYIYDNDKWVKTNGNVDYTGIYYTVNSKKEYYVQFKDEAKIYGAQQWEVYMYGTVITCPEYVSSGGTGGSTAFIVHLKGDTNCLKCFRYRFTKHKGLYKNVSSTWHWTSNTKTGIVTIVFDSAHQRETFIKTIKVPPSVTLSLGIMTLGGGGGDPQERPRKLPQLCTELQTTIHDIILECVYCKQQLLRREVYDFARRDLCIVYRDGNPYAVCDKCLKFYSKISEYRHYCYSLYGTTLEQQYNKPLCDLLIRRINCQKPLCPEEKQRHLDKKQRFHNIRGRWTGRCMSCCRSSGGGGGDPTRRPYKLPDLCTELNTSLQDIEITCVYCKTVLELTEVFEFARKDLFVVYRDSIPHAACHKCIDFYSRIRELRHYSDSVYGDTLEKLTNTGLYNLLIRRLRCQKPLNPAEKLRHLNEKRRFHNIAGHYRGQCHSCCNRAGGGGGDAEEKPRTLHDLCQALETSVHEIELKCVECKKTLQRSEVYDFVRADLRIVYRDGNPFAVCKVCLRLLSKISEYRHYNYSLYGDTLEQTLKKCLNEILIRRIICQRPLCPQEKKRHVDLNKRFHNISGRWTGRCAVCWRPRGGGGGNPQERPRSLHHLSEVLEIPLIDLRLSCVYCKKELTRAEVYNFARTELKLVYRDDFPYAVCRVCLLFYSKVRKYRYYDYSVYGATLESITKKQLCDLLIRRYRCQSPLTPEEKQLHCDRKRRFHLIAHGWTGSCLGCWRQTGGGGGNSEERPYKLQALCDEVNISIHDINLDCVFCQRGLYRSEVYDFARSDLCIVYRKDKPYGVCQPCLKFYSKIREYRRYRQSVYGTTLENLTNKQLCNILIRRGKCQKPLCPLEKQKHVDEKKRFHQIAEQWTGRCTRCWRPSGGGGGAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTDKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLGGGGGKQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTDKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLDLGGGGGRAHYNIVTFCCKCDSTLRLCVQSTHVDIRTLEDLLMGTLGIVCPICSQKPTLHEYMLDLQPETTDLYGYQQLGGGGGRHTMLCMCCKCEARIKLVVESSADDLRAFQQLFLNTLSFVCPWCASQQTLQDIVLHLEPQNEIPVDLLGHQQLSDSEEENDEID

SEQ ID NO: 64 - protein, 1599 aa, artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIAKHGYTVEVQFDGDICNTMHYTNWTHIYICEEASVTVVEGQVDYYGLYYVHEGIRTYFVQFKDDAEKYSKNKVWEVHAGGQVILCPTSVFSGGTGGSTTPIVHLKGDANTLKCLRYRFKKHCTLYTAVSSTWHWTGHNVKHKSAIVTLTYDSEWQRDQFLSQVKIPKTITVSTGFMSIGGGGGMQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFAKGGQTVQVYFDGNKDNCMTYVAWDSVYYMTDAGTWDKTATCVSHRGLYYVKEGYNTFYIEFKSECEKYGNTGTWEVHFGNNVIDCNDSMCSGGTGGSTTPIIHLKGDRNSLKCLRYRLRKHSDHYRDISSTWHWTGAGNEKTGILTVTYHSETQRTKFLNTVAIPDSVQILVGYMTMGGGGGMETLCHRLNVCQEKILDCYELDSDKLVDQINYWTLLRYEAAMFYAARERNLRTINHQVVPATTVSKQKACQAIEMHMALQSLNKSDYNMEPWTMRETCYELWCVAPKQCFAKGGITVTVIFDGNKDNAMDYTSWKFIYIYDNDKWVKTNGNVDYTGIYYTVNSKKEYYVQFKDEAKIYGAQQWEVYMYGTVITCPEYVSSGGTGGSTAFIVHLKGDTNCLKCFRYRFTKHKGLYKNVSSTWHWTSNTKTGIVTIVFDSAHQRETFIKTIKVPPSVTLSLGIMTLGGGGGDPQERPRKLPQLCTELQTTIHDIILECVYCKQQLLRREVYDFARRDLCIVYRDGNPYAVCDKCLKFYSKISEYRHYCYSLYGTTLEQQYNKPLCDLLIRRINCQKPLCPEEKQRHLDKKQRFHNIRGRWTGRCMSCCRSSGGGGGDPTRRPYKLPDLCTELNTSLQDIEITCVYCKTVLELTEVFEFARKDLFVVYRDSIPHAACHKCIDFYSRIRELRHYSDSVYGDTLEKLTNTGLYNLLIRRLRCQKPLNPAEKLRHLNEKRRFHNIAGHYRGQCHSCCNRAGGGGGDAEEKPRTLHDLCQALETSVHEIELKCVECKKTLQRSEVYDFVRADLRIVYRDGNPFAVCKVCLRLLSKISEYRHYNYSLYGDTLEQTLKKCLNEILIRRIICQRPLCPQEKKRHVDLNKRFHNISGRWTGRCAVCWRPRGGGGGNPQERPRSLHHLSEVLEIPLIDLRLSCVYCKKELTRAEVYNFARTELKLVYRDDFPYAVCRVCLLFYSKVRKYRYYDYSVYGATLESITKKQLCDLLIRRYRCQSPLTPEEKQLHCDRKRRFHLIAHGWTGSCLGCWRQTGGGGGNSEERPYKLQALCDEVNISIHDINLDCVFCQRGLYRSEVYDFARSDLCIVYRKDKPYGVCQPCLKFYSKIREYRRYRQSVYGTTLENLTNKQLCNILIRRGKCQKPLCPLEKQKHVDEKKRFHQIAEQWTGRCTRCWRPS

SEQ ID NO: 65 - protein, 1012 aa, artificial
  synthetic polypeptide
MAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTDKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLGGGGGKQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTDKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLDLGGGGGRAHYNIVTFCCKCDSTLRLCVQSTHVDIRTLEDLLMGTLGIVCPICSQKPTLHEYMLDLQPETTDLYGYQQLGGGGGRHTMLCMCCKCEARIKLVVESSADDLRAFQQLFLNTLSFVCPWCASQQTLQDIVLHLEPQNEIPVDLLGHQQLSDSEEENDEID

SEQ ID NO: 66 - protein, 1732 aa, artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIAKHGYTVEVQFDGDICNTMHYTNWTHIYICEEASVTVVEGQVDYYGLYYVHEGIRTYFVQFKDDAEKYSKNKVWEVHAGGQVILCPTSVFSGGTGGSTTPIVHLKGDANTLKCLRYRFKKHCTLYTAVSSTWHWTGHNVKHKSAIVTLTYDSEWQRDQFLSQVKIPKTITVSTGFMSIAPVKQTLNFDLLKLAGDVESNPGPMQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFAKGGQTVQVYFDGNKDNCMTYVAWDSVYYMTDAGTWDKTATCVSHRGLYYVKEGYNTFYIEFKSECEKYGNTGTWEVHFGNNVIDCNDSMCSGGTGGSTTPIIHLKGDRNSLKCLRYRLRKHSDHYRDISSTWHWTGAGNEKTGILTVTYHSETQRTKFLNTVAIPDSVQILVGYMTMAPVKQTLNFDLLKLAGDVESNPGPMETLCHRLNVCQEKILDCYELDSDKLVDQINYWTLLRYEAAMFYAARERNLRTINHQVVPATTVSKQKACQAIEMHMALQSLNKSDYNMEPWTMRETCYELWCVAPKQCFAKGGITVTVIFDGNKDNAMDYTSWKFIYIYDNDKWVKTNGNVDYTGIYYTVNSKKEYYVQFKDEAKIYGAQQWEVYMYGTVITCPEYVSSGGTGGSTAFIVHLKGDTNCLKCFRYRFTKHKGLYKNVSSTWHWTSNTKTGIVTIVFDSAHQRETFIKTIKVPPSVTLSLGIMTLAPVKQTLNFDLLKLAGDVESNPGPDPQERPRKLPQLCTELQTTIHDIILECVYCKQQLLRREVYDFARRDLCIVYRDGNPYAVCDKCLKFYSKISEYRHYCYSLYGTTLEQQYNKPLCDLLIRRINCQKPLCPEEKQRHLDKKQRFHNIRGRWTGRCMSCCRSSAPVKQTLNFDLLKLAGDVESNPGPDPTRRPYKLPDLCTELNTSLQDIEITCVYCKTVLELTEVFEFARKDLFVVYRDSIPHAACHKCIDFYSRIRELRHYSDSVYGDTLEKLTNTGLYNLLIRRLRCQKPLNPAEKLRHLNEKRRFHNIAGHYRGQCHSCCNRAAPVKQTLNFDLLKLAGDVESNPGPDAEEKPRTLHDLCQALETSVHEIELKCVECKKTLQRSEVYDFVRADLRIVYRDGNPFAVCKVCLRLLSKISEYRHYNYSLYGDTLEQTLKKCLNEILIRRIICQRPLCPQEKKRHVDLNKRFHNISGRWTGRCAVCWRPRAPVKQTLNFDLLKLAGDVESNPGPNPQERPRSLHHLSEVLEIPLIDLRLSCVYCKKELTRAEVYNFARTELKLVYRDDFPYAVCRVCLLFYSKVRKYRYYDYSVYGATLESITKKQLCDLLIRRYRCQSPLTPEEKQLHCDRKRRFHLIAHGWTGSCLGCWRQTAPVKQTLNFDLLKLAGDVESNPGPNSEERPYKLQALCDEVNISIHDINLDCVFCQRGLYRSEVYDFARSDLCIVYRKDKPYGVCQPCLKFYSKIREYRRYRQSVYGTTLENLTNKQLCNILIRRGKCQKPLCPLEKQKHVDEKKRFHQIAEQWTGRCTRCWRPS

SEQ ID NO: 67 - protein, 1069 aa, artificial
  synthetic polypeptide
MAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTDKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLAPVKQTLNFDLLKLAGDVESNPGPKQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTDKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLDLAPVKQTLNFDLLKLAGDVESNPGPRAHYNIVTFCCKCDSTLRLCVQSTHVDIRTLEDLLMGTLGIVCPICSQKPTLHEYMLDLQPETTDLYGYQQLAPVKQTLNFDLLKLAGDVESNPGPRHTMLCMCCKCEARIKLVVESSADDLRAFQQLFLNTLSFVCPWCASQQTLQDIVLHLEPQNEIPVDLLGHQQLSDSEEENDEID

SEQ ID NO: 68 - protein, 420 aa, artificial
  synthetic polypeptide
AKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTGKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSL

SEQ ID NO: 69 - protein, 420 aa, artificial
  synthetic polypeptide
KQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTGKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLDL

SEQ ID NO: 70 - protein, 420 aa, artificial
  synthetic polypeptide
TKANILYKFKEAYGISFMELVRPFKSDKTSCTDWCITGYGISPSVAESLKVLIKQHSLYTHLQCLTCDRGIIILLLIRFRCSKNRLTVAKLMSNLLSIPETCMVIEPPKLRSQTCALYWFRTAMSNISDVQGTTPEWIDRLTVLQHSFNDNIFDLSEMVQWAYDNELTDDSDIAYYYAQLADSNSNAAAFLKSNSQAKIVKDCGIMCRHYKKAEKRKMSIGQWIQSRCEKTNDGGNWRPIVQLLRYQNIEFTAFLGAFKKFLKGIPKKSCMLICGPANTGKSYFGMSLIQFLKGCVISCVNSKSHFWLQPLSDAKIGMIDDVTPISWTYIDDYMRNALDGNEISIDVKHRALVQLKCPPLLLTSNTNAGTDSRWPYLHSRLTVFEFKNPFPFDENGNPVYAINDENWKSFFSRTWCKLDL

SEQ ID NO: 71 - protein, 288 aa, artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIKKHGYTVEVQFDGDICNTMHYTNWTHIYICEEASVTVVEGQVDYYGLYYVHEGIRTYFVQFKDDAEKYSKNKVWEVHAGGQVILCPTSVFSGGTGGSTTPIVHLKGDANTLKCLRYRFKKHCTLYTAVSSTWHWTGHNVKHKSAIVTLTYDSEWQRDQFLSQVKIPKTITVSTGFMSI

SEQ ID NO: 72 - protein, 292 aa, artificial
  synthetic polypeptide
MQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFKKGGQTVQVYFDGNKDNCMTYVAWDSVYYMTDAGTWDKTATCVSHRGLYYVKEGYNTFYIEFKSECEKYGNTGTWEVHFGNNVIDCNDSMCSGGTGGSTTPIIHLKGDRNSLKCLRYRLRKHSDHYRDISSTWHWTGAGNEKTGILTVTYHSETQRTKFLNTVAIPDSVQILVGYMTM

SEQ ID NO: 73 - protein, 288 aa, artificial
  synthetic polypeptide
METLSQRLNVCQDKILEHYENDSKRLCDHIDYWKHIRLECVLMYKAREMGIHSINHQVVPALSVSKAKALQAIELQMMLETLNNTEYKNEDWTMQQTSLELYLTAPTGCLKKHGYTVEVQFDGDVHNTMHYTNWKFIYLCIDGQCTVVEGQVNCKGIYYVHEGHITYFVNFTEEAKKYGTGKKWEVHAGGQVIVFPESVFSGGTGGSTTPIIHLKGDANILKCLRYRLSKYKQLYEQVSSTWHWTCTDGKHKNAIVTLTYISTSQRDDFLNTVKIPNTVSVSTGYMTI

SEQ ID NO: 74 - protein, 288 aa, artificial
  synthetic polypeptide
MEEISARLNAVQEKILDLYEADKTDLPSQIEHWKLIRMECALLYTAKQMGFSHLCHQVVPSLLASKTKAFQVIELQMALETLSKSQYSTSQWTLQQTSLEVWLCEPPKCFKKQGETVTVQYDNDKKNTMDYTNWGEIYIIEEDTCTMVTGKVDYIGMYYIHNCEKVYFKYFKEDAAKYSKTQMWEVHVGGQVIVCPTSISSGGTGGSVAPIVHLKGESNSLKCLRYRLKPYKELYSSMSSTWHWTSDNKNSKNGIVTVTFVTEQQQQMFLGTVKIPPTVQISTGFMTL

SEQ ID NO: 75 - protein, 293 aa, artificial
  synthetic polypeptide
MKMQTPKESLSERLSALQDKILDHYENDSKDINSQISYWQLIRLENAILFTAREHGITKLNHQVVPPINISKSKAHKAIELQMALKGLAQSKYNNEEWTLQDTCEELWNTEPSQCFKKGGKTVHVYFDGNKDNCMNYVVWDSIYYITETGIWDKTAACVSYWGVYYIKDGDTTYYVQFKSECEKYGNSNTWEVQYGGNVIDCNDSMCSGGTGGSTTPIIHLKGDKNSLKCLRYRLRKYADHYSEISSTWHWTGCNKNTGILTVTYNSEVQRNTFLDVVTIPNSVQISVGYMTI

SEQ ID NO: 76 - protein, 289 aa, artificial
  synthetic polypeptide
MESIPARLNAVQEKILDLYEADSNDLNAQIEHWKLTRMECVLFYKAKELGITHIGHQVVPPMAVSKAKACQAIELQLALEALNKTQYSTDGWTLQQTSLEMWRAEPQKYFKKHGYTITVQYDNDKNNTMDYTNWKEIYLLGECECTIVEGQVDYYGLYYWCDGEKIYFVKFSNDAKQYCVTGVWEVHVGGQVIVCPASVSSGGTGGSTAPIIHLKGDPNSLKCLRYRVKTHKSLYVQISSTWHWTSNECTNNKLGIVTITYSDETQRQQFLKTVKIPNTVQVIQGVMSL

SEQ ID NO: 77 - protein, 288 aa, artificial
  synthetic polypeptide
MEEISARLSAVQDKILDIYEADKNDLTSQIEHWKLIRMECAIMYTARQMGISHLCHQVVPSLVASKTKAFQVIELQMALETLNASPYKTDEWTLQQTSLEVWLSEPQKCFKKKGITVTVQYDNDKANTMDYTNWSEIYIIEETTCTLVAGEVDYVGLYYIHGNEKTYFKYFKEDAKKYSKTQLWEVHVGSRVIVCPTSIPSGGTGGSVSPIVHLKGDPNSLKCLRYRLKPFKDLYCNMSSTWHWTSDDKGDKVGIVTVTYTTETQRQLFLNTVKIPPTVQISTGVMSL

SEQ ID NO: 78 - protein, 140 aa, artificial
  synthetic polypeptide
DPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSS

SEQ ID NO: 79 - protein, 140 aa, artificial
  synthetic polypeptide
DPTRRPYKLPDLCTELNTSLQDIEITCVYCKTVLELTEVFEFAFKDLFVVYRDSIPHAACHKCIDFYSRIRELRHYSDSVYGDTLEKLTNTGLYNLLIRCLRCQKPLNPAEKLRHLNEKRRFHNIAGHYRGQCHSCCNRA

SEQ ID NO: 80 - protein, 140 aa, artificial
  synthetic polypeptide
NPAERPRKLHELSSALEIPYDELRLNCVYCKGQLTETEVLDFAFTDLTIVYRDDTPHGVCTKCLRFYSKVSEFRWYRYSVYGTTLEKLTNKGICDLLIRCITCQRPLCPEEKQRHLDKKKRFHNIGGRWTGRCIACWRRP

SEQ ID NO: 81 - protein, 140 aa, artificial
  synthetic polypeptide
DTEEKPRTLHDLCQALETTIHNIELQCVECKKPLQRSEVYDFAFADLTVVYREGNPFGICKLCLRFLSKISEYRHYNYSVYGNTLEQTVKKPLNEILIRCIICQRPLCPQEKKRHVDLNKRFHNISGRWAGRCAACWRSR

SEQ ID NO: 82 - protein, 140 aa, artificial
  synthetic polypeptide
DPKQRPYKLPDLCTELNTSLQDVSIACVYCKATLERTEVYQFAFKDLCIVYRDCIAYAACHKCIDFYSRIRELRYYSNSVYGETLEKITNTELYNLLIRCLRCQKPLNPAEKRRHLKDKRRFHSIAGQYRGQCNTCCDQA

SEQ ID NO: 83 - protein, 140 aa, artificial
  synthetic polypeptide
DPATRPRTLHELCEVLEESVHEIRLQCVQCKKELQRREVYKFLFTDLRIVYRDNNPYGVCIMCLRFLSKISEYRHYQYSLYGKTLEERVKKPLSEITIRCIICQTPLCPEEKERHVNANKRFHNIMGRWTGRCSECWRPR

SEQ ID NO: 84 - protein, 140 aa, artificial
  synthetic polypeptide
DAEEKPRTLHDLCQALETSVHEIELKCVECKKTLQRSEVYDFVFADLRIVYRDGNPFAVCKVCLRLLSKISEYRHYNYSLYGDTLEQTLKKCLNEILIRCIICQRPLCPQEKKRHVDLNKRFHNISGRWTGRCAVCWRPR

SEQ ID NO: 85 - protein, 2322 aa, artificial
  synthetic polypeptide
MAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTGKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLGGGGGKQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTGKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLDLGGGGGTKANILYKFKEAYGISFMELVRPFKSDKTSCTDWCITGYGISPSVAESLKVLIKQHSLYTHLQCLTCDRGIIILLLIRFRCSKNRLTVAKLMSNLLSIPETCMVIEPPKLRSQTCALYWFRTAMSNISDVQGTTPEWIDRLTVLQHSFNDNIFDLSEMVQWAYDNELTDDSDIAYYYAQLADSNSNAAAFLKSNSQAKIVKDCGIMCRHYKKAEKRKMSIGQWIQSRCEKTNDGGNWRPIVQLLRYQNIEFTAFLGAFKKFLKGIPKKSCMLICGPANTGKSYFGMSLIQFLKGCVISCVNSKSHFWLQPLSDAKIGMIDDVTPISWTYIDDYMRNALDGNEISIDVKHRALVQLKCPPLLLTSNTNAGTDSRWPYLHSRLTVFEFKNPFPFDENGNPVYAINDENWKSFFSRTWCKLDLGGGGGRAHYNIVTFCCKCDSTLRLCVQSTHVDIRTLEDLLMGTLGIVCPICSQKPTLHEYMLDLQPETTDLYGYQQLGGGGGRHTMLCMCCKCEARIKLVVESSADDLRAFQQLFLNTLSFVCPWCASQQTLQDIVLHLEPQNEIPVDLLGHQQLSDSEEENDEIDGGGGGMKMQTPKESLSERLSALQDKILDHYENDSKDINSQISYWQLIRLENAILFTAREHGITKLNHQVVPPINISKSKAHKAIELQMALKGLAQSKYNNEEWTLQDTCEELWNTEPSQCFKKGGKTVHVYFDGNKDNCMNYVVWDSIYYITETGIWDKTAACVSYWGVYYIKDGDTTYYVQFKSECEKYGNSNTWEVQYGGNVIDCNDSMCSGGTGGSTTPIIHLKGDKNSLKCLRYRLRKYADHYSEISSTWHWTGCNKNTGILTVTYNSEVQRNTFLDVVTIPNSVQISVGYMTIGGGGGMESIPARLNAVQEKILDLYEADSNDLNAQIEHWKLTRMECVLFYKAKELGITHIGHQVVPPMAVSKAKACQAIELQLALEALNKTQYSTDGWTLQQTSLEMWRAEPQKYFKKHGYTITVQYDNDKNNTMDYTNWKEIYLLGECECTIVEGQVDYYGLYYWCDGEKIYFVKFSNDAKQYCVTGVWEVHVGGQVIVCPASVSSGGTGGSTAPIIHLKGDPNSLKCLRYRVKTHKSLYVQISSTWHWTSNECTNNKLGIVTITYSDETQRQQFLKTVKIPNTVQVIQGVMSLGGGGGMEEISARLSAVQDKILDIYEADKNDLTSQIEHWKLIRMECAIMYTARQMGISHLCHQVVPSLVASKTKAFQVIELQMALETLNASPYKTDEWTLQQTSLEVWLSEPQKCFKKKGITVTVQYDNDKANTMDYTNWSEIYIIEETTCTLVAGEVDYVGLYYIHGNEKTYFKYFKEDAKKYSKTQLWEVHVGSRVIVCPTSIPSGGTGGSVSPIVHLKGDPNSLKCLRYRLKPFKDLYCNMSSTWHWTSDDKGDKVGIVTVTYTTETQRQLFLNTVKIPPTVQISTGVMSL

SEQ ID NO: 86 - protein, 2455 aa, artificial
  synthetic polypeptide
MAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTGKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLAPVKQTLNFDLLKLAGDVESNPGPKQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTGKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLDLAPVKQTLNFDLLKLAGDVESNPGPTKANILYKFKEAYGISFMELVRPFKSDKTSCTDWCITGYGISPSVAESLKVLIKQHSLYTHLQCLTCDRGIIILLLIRFRCSKNRLTVAKLMSNLLSIPETCMVIEPPKLRSQTCALYWFRTAMSNISDVQGTTPEWIDRLTVLQHSFNDNIFDLSEMVQWAYDNELTDDSDIAYYYAQLADSNSNAAAFLKSNSQAKIVKDCGIMCRHYKKAEKRKMSIGQWIQSRCEKTNDGGNWRPIVQLLRYQNIEFTAFLGAFKKFLKGIPKKSCMLICGPANTGKSYFGMSLIQFLKGCVISCVNSKSHFWLQPLSDAKIGMIDDVTPISWTYIDDYMRNALDGNEISIDVKHRALVQLKCPPLLLTSNTNAGTDSRWPYLHSRLTVFEFKNPFPFDENGNPVYAINDENWKSFFSRTWCKLDLAPVKQTLNFDLLKLAGDVESNPGPRAHYNIVTFCCKCDSTLRLCVQSTHVDIRTLEDLLMGTLGIVCPICSQKPTLHEYMLDLQPETTDLYGYQQLAPVKQTLNFDLLKLAGDVESNPGPRHTMLCMCCKCEARIKLVVESSADDLRAFQQLFLNTLSFVCPWCASQQTLQDIVLHLEPQNEIPVDLLGHQQLSDSEEENDEIDAPVKQTLNFDLLKLAGDVESNPGPMKMQTPKESLSERLSALQDKILDHYENDSKDINSQISYWQLIRLENAILFTAREHGITKLNHQVVPPINISKSKAHKAIELQMALKGLAQSKYNNEEWTLQDTCEELWNTEPSQCFKKGGKTVHVYFDGNKDNCMNYVVWDSIYYITETGIWDKTAACVSYWGVYYIKDGDTTYYVQFKSECEKYGNSNTWEVQYGGNVIDCNDSMCSGGTGGSTTPIIHLKGDKNSLKCLRYRLRKYADHYSEISSTWHWTGCNKNTGILTVTYNSEVQRNTFLDVVTIPNSVQISVGYMTIAPVKQTLNFDLLKLAGDVESNPGPMESIPARLNAVQEKILDLYEADSNDLNAQIEHWKLTRMECVLFYKAKELGITHIGHQVVPPMAVSKAKACQAIELQLALEALNKTQYSTDGWTLQQTSLEMWRAEPQKYFKKHGYTITVQYDNDKNNTMDYTNWKEIYLLGECECTIVEGQVDYYGLYYWCDGEKIYFVKFSNDAKQYCVTGVWEVHVGGQVIVCPASVSSGGTGGSTAPIIHLKGDPNSLKCLRYRVKTHKSLYVQISSTWHWTSNECTNNKLGIVTITYSDETQRQQFLKTVKIPNTVQVIQGVMSLAPVKQTLNFDLLKLAGDVESNPGPMEEISARLSAVQDKILDIYEADKNDLTSQIEHWKLIRMECAIMYTARQMGISHLCHQVVPSLVASKTKAFQVIELQMALETLNASPYKTDEWTLQQTSLEVWLSEPQKCFKKKGITVTVQYDNDKANTMDYTNWSEIYIIEETTCTLVAGEVDYVGLYYIHGNEKTYFKYFKEDAKKYSKTQLWEVHVGSRVIVCPTSIPSGGTGGSVSPIVHLKGDPNSLKCLRYRLKPFKDLYCNMSSTWHWTSDDKGDKVGIVTVTYTTETQRQLFLNTVKIPPTVQISTGVMSL

SEQ ID NO: 87 - protein, 2186 aa, artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIKKHGYTVEVQFDGDICNTMHYTNWTHIYICEEASVTVVEGQVDYYGLYYVHEGIRTYFVQFKDDAEKYSKNKVWEVHAGGQVILCPTSVFSGGTGGSTTPIVHLKGDANTLKCLRYRFKKHCTLYTAVSSTWHWTGHNVKHKSAIVTLTYDSEWQRDQFLSQVKIPKTITVSTGFMSIGGGGGMQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFKKGGQTVQVYFDGNKDNCMTYVAWDSVYYMTDAGTWDKTATCVSHRGLYYVKEGYNTFYIEFKSECEKYGNTGTWEVHFGNNVIDCNDSMCSGGTGGSTTPIIHLKGDRNSLKCLRYRLRKHSDHYRDISSTWHWTGAGNEKTGILTVTYHSETQRTKFLNTVAIPDSVQILVGYMTMGGGGGMETLSQRLNVCQDKILEHYENDSKRLCDHIDYWKHIRLECVLMYKAREMGIHSINHQVVPALSVSKAKALQAIELQMMLETLNNTEYKNEDWTMQQTSLELYLTAPTGCLKKHGYTVEVQFDGDVHNTMHYTNWKFIYLCIDGQCTVVEGQVNCKGIYYVHEGHITYFVNFTEEAKKYGTGKKWEVHAGGQVIVFPESVFSGGTGGSTTPIIHLKGDANILKCLRYRLSKYKQLYEQVSSTWHWTCTDGKHKNAIVTLTYISTSQRDDFLNTVKIPNTVSVSTGYMTIGGGGGMEEISARLNAVQEKILDLYEADKTDLPSQIEHWKLIRMECALLYTAKQMGFSHLCHQVVPSLLASKTKAFQVIELQMALETLSKSQYSTSQWTLQQTSLEVWLCEPPKCFKKQGETVTVQYDNDKKNTMDYTNWGEIYIIEEDTCTMVTGKVDYIGMYYIHNCEKVYFKYFKEDAAKYSKTQMWEVHVGGQVIVCPTSISSGGTGGSVAPIVHLKGESNSLKCLRYRLKPYKELYSSMSSTWHWTSDNKNSKNGIVTVTFVTEQQQQMFLGTVKIPPTVQISTGFMTLGGGGGDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSGGGGGDPTRRPYKLPDLCTELNTSLQDIEITCVYCKTVLELTEVFEFAFKDLFVVYRDSIPHAACHKCIDFYSRIRELRHYSDSVYGDTLEKLTNTGLYNLLIRCLRCQKPLNPAEKLRHLNEKRRFHNIAGHYRGQCHSCCNRAGGGGGNPAERPRKLHELSSALEIPYDELRLNCVYCKGQLTETEVLDFAFTDLTIVYRDDTPHGVCTKCLRFYSKVSEFRWYRYSVYGTTLEKLTNKGICDLLIRCITCQRPLCPEEKQRHLDKKKRFHNIGGRWTGRCIACWRRPGGGGGDTEEKPRTLHDLCQALETTIHNIELQCVECKKPLQRSEVYDFAFADLTVVYREGNPFGICKLCLRFLSKISEYRHYNYSVYGNTLEQTVKKPLNEILIRCIICQRPLCPQEKKRHVDLNKRFHNISGRWAGRCAACWRSRGGGGGDPKQRPYKLPDLCTELNTSLQDVSIACVYCKATLERTEVYQFAFKDLCIVYRDCIAYAACHKCIDFYSRIRELRYYSNSVYGETLEKITNTELYNLLIRCLRCQKPLNPAEKRRHLKDKRRFHSIAGQYRGQCNTCCDQAGGGGGDPATRPRTLHELCEVLEESVHEIRLQCVQCKKELQRREVYKFLFTDLRIVYRDNNPYGVCIMCLRFLSKISEYRHYQYSLYGKTLEERVKKPLSEITIRCIICQTPLCPEEKERHVNANKRFHNIMGRWTGRCSECWRPRGGGGGDAEEKPRTLHDLCQALETSVHEIELKCVECKKTLQRSEVYDFVFADLRIVYRDGNPFAVCKVCLRLLSKISEYRHYNYSLYGDTLEQTLKKCLNEILIRCIICQRPLCPQEKKRHVDLNKRFHNISGRWTGRCAVCWRPR

SEQ ID NO: 88 - protein, 2376 aa, artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIKKHGYTVEVQFDGDICNTMHYTNWTHIYICEEASVTVVEGQVDYYGLYYVHEGIRTYFVQFKDDAEKYSKNKVWEVHAGGQVILCPTSVFSGGTGGSTTPIVHLKGDANTLKCLRYRFKKHCTLYTAVSSTWHWTGHNVKHKSAIVTLTYDSEWQRDQFLSQVKIPKTITVSTGFMSIAPVKQTLNFDLLKLAGDVESNPGPMQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFKKGGQTVQVYFDGNKDNCMTYVAWDSVYYMTDAGTWDKTATCVSHRGLYYVKEGYNTFYIEFKSECEKYGNTGTWEVHFGNNVIDCNDSMCSGGTGGSTTPIIHLKGDRNSLKCLRYRLRKHSDHYRDISSTWHWTGAGNEKTGILTVTYHSETQRTKFLNTVAIPDSVQILVGYMTMAPVKQTLNFDLLKLAGDVESNPGPMETLSQRLNVCQDKILEHYENDSKRLCDHIDYWKHIRLECVLMYKAREMGIHSINHQVVPALSVSKAKALQAIELQMMLETLNNTEYKNEDWTMQQTSLELYLTAPTGCLKKHGYTVEVQFDGDVHNTMHYTNWKFIYLCIDGQCTVVEGQVNCKGIYYVHEGHITYFVNFTEEAKKYGTGKKWEVHAGGQVIVFPESVFSGGTGGSTTPIIHLKGDANILKCLRYRLSKYKQLYEQVSSTWHWTCTDGKHKNAIVTLTYISTSQRDDFLNTVKIPNTVSVSTGYMTIAPVKQTLNFDLLKLAGDVESNPGPMEEISARLNAVQEKILDLYEADKTDLPSQIEHWKLIRMECALLYTAKQMGFSHLCHQVVPSLLASKTKAFQVIELQMALETLSKSQYSTSQWTLQQTSLEVWLCEPPKCFKKQGETVTVQYDNDKKNTMDYTNWGEIYIIEEDTCTMVTGKVDYIGMYYIHNCEKVYFKYFKEDAAKYSKTQMWEVHVGGQVIVCPTSISSGGTGGSVAPIVHLKGESNSLKCLRYRLKPYKELYSSMSSTWHWTSDNKNSKNGIVTVTFVTEQQQQMFLGTVKIPPTVQISTGFMTLAPVKQTLNFDLLKLAGDVESNPGPDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSAPVKQTLNFDLLKLAGDVESNPGPDPTRRPYKLPDLCTELNTSLQDIEITCVYCKTVLELTEVFEFAFKDLFVVYRDSIPHAACHKCIDFYSRIRELRHYSDSVYGDTLEKLTNTGLYNLLIRCLRCQKPLNPAEKLRHLNEKRRFHNIAGHYRGQCHSCCNRAAPVKQTLNFDLLKLAGDVESNPGPNPAERPRKLHELSSALEIPYDELRLNCVYCKGQLTETEVLDFAFTDLTIVYRDDTPHGVCTKCLRFYSKVSEFRWYRYSVYGTTLEKLTNKGICDLLIRCITCQRPLCPEEKQRHLDKKKRFHNIGGRWTGRCIACWRRPAPVKQTLNFDLLKLAGDVESNPGPDTEEKPRTLHDLCQALETTIHNIELQCVECKKPLQRSEVYDFAFADLTVVYREGNPFGICKLCLRFLSKISEYRHYNYSVYGNTLEQTVKKPLNEILIRCIICQRPLCPQEKKRHVDLNKRFHNISGRWAGRCAACWRSRAPVKQTLNFDLLKLAGDVESNPGPDPKQRPYKLPDLCTELNTSLQDVSIACVYCKATLERTEVYQFAFKDLCIVYRDCIAYAACHKCIDFYSRIRELRYYSNSVYGETLEKITNTELYNLLIRCLRCQKPLNPAEKRRHLKDKRRFHSIAGQYRGQCNTCCDQAAPVKQTLNFDLLKLAGDVESNPGPDPATRPRTLHELCEVLEESVHEIRLQCVQCKKELQRREVYKFLFTDLRIVYRDNNPYGVCIMCLRFLSKISEYRHYQYSLYGKTLEERVKKPLSEITIRCIICQTPLCPEEKERHVNANKRFHNIMGRWTGRCSECWRPRAPVKQTLNFDLLKLAGDVESNPGPDAEEKPRTLHDLCQALETSVHEIELKCVECKKTLQRSEVYDFVFADLRIVYRDGNPFAVCKVCLRLLSKISEYRHYNYSLYGDTLEQTLKKCLNEILIRCIICQRPLCPQEKKRHVDLNKRFHNISGRWTGRCAVCWRPR

SEQ ID NO: 89 - protein, 420 aa, artificial
  synthetic polypeptide
GKAAMLGKFKELYGVSFMELIRPFQSNKSTCTDWCVAAFGVTGTVAEGFKTLLQPYCLYCHLQSLACSWGMVMLMLVRFKCAKNRITIEKLLEKLLCISTNCMLIQPPKLRSTAAALYWYRTGMSNISDVYGETPEWIERQTVLQHSFNDTTFDLSQMVQWAYDNDVMDDSEIAYKYAQLADSDSNACAFLKSNSQAKIVKDCGTMCRHYKRAEKRQMSMGQWIKSRCDKVSDEGDWRDIVKFLRYQQIEFVSFLSALKLFLKGVPKKNCILIHGAPNTGKSYFGMSLISFLQGCIISYANSKSHFWLQPLADAKIGMLDDATTPCWHYIDNYLRNALDGNPVSIDVKHKALMQLKCPPLLITSNINAGKDDRWPYLHSRLVVFTFPNPFPFDKNGNPVYELSDKNWKSFFSRTWCRLNL

SEQ ID NO: 90 - protein, 420 aa, artificial
  synthetic polypeptide
KKAAMLAVFKDIYGLSFTDLVRNFKSDKTTCTDWVMAIFGVNPTVAEGFKTLIKPATLYAHIQCLDCKWGVLILALLRYKCGKNRLTVAKGLSTLLHVPETCMLIEPPKLRSSVAALYWYRTGISNISEVSGDTPEWIQRLTIIQHGIDDSNFDLSDMVQWAFDNDLTDESDMAFQYAQLADCNSNAAAFLKSNCQAKYLKDCAVMCRHYKRAQKRQMNMSQWIKYRCSKIDEGGDWRPIVQFLRYQGVEFISFLRALKEFLKGTPKKNCILLYGPANTGKSYFGMSFIHFLQGAIISFVNSNSHFWLEPLADTKVAMLDDATHTCWTYFDNYMRNALDGNPISIDRKHKPLLQLKCPPILLTSNIDPAKDNKWPYLESRVTVFTFPHAFPFDKNGNPVYEINDKNWKCFFERTWSRLDL

SEQ ID NO: 91 - protein, 2286 aa, artificial
  synthetic polypeptide
MAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTGKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLGGGGGKQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTGKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLDLGGGGGGKAAMLGKFKELYGVSFMELIRPFQSNKSTCTDWCVAAFGVTGTVAEGFKTLLQPYCLYCHLQSLACSWGMVMLMLVRFKCAKNRITIEKLLEKLLCISTNCMLIQPPKLRSTAAALYWYRTGMSNISDVYGETPEWIERQTVLQHSFNDTTFDLSQMVQWAYDNDVMDDSEIAYKYAQLADSDSNACAFLKSNSQAKIVKDCGTMCRHYKRAEKRQMSMGQWIKSRCDKVSDEGDWRDIVKFLRYQQIEFVSFLSALKLFLKGVPKKNCILIHGAPNTGKSYFGMSLISFLQGCIISYANSKSHFWLQPLADAKIGMLDDATTPCWHYIDNYLRNALDGNPVSIDVKHKALMQLKCPPLLITSNINAGKDDRWPYLHSRLVVFTFPNPFPFDKNGNPVYELSDKNWKSFFSRTWCRLNLGGGGGTKANILYKFKEAYGISFMELVRPFKSDKTSCTDWCITGYGISPSVAESLKVLIKQHSLYTHLQCLTCDRGIIILLLIRFRCSKNRLTVAKLMSNLLSIPETCMVIEPPKLRSQTCALYWFRTAMSNISDVQGTTPEWIDRLTVLQHSFNDNIFDLSEMVQWAYDNELTDDSDIAYYYAQLADSNSNAAAFLKSNSQAKIVKDCGIMCRHYKKAEKRKMSIGQWIQSRCEKTNDGGNWRPIVQLLRYQNIEFTAFLGAFKKFLKGIPKKSCMLICGPANTGKSYFGMSLIQFLKGCVISCVNSKSHFWLQPLSDAKIGMIDDVTPISWTYIDDYMRNALDGNEISIDVKHRALVQLKCPPLLLTSNTNAGTDSRWPYLHSRLTVFEFKNPFPFDENGNPVYAINDENWKSFFSRTWCKLDLGGGGGKKAAMLAVFKDIYGLSFTDLVRNFKSDKTTCTDWVMAIFGVNPTVAEGFKTLIKPATLYAHIQCLDCKWGVLILALLRYKCGKNRLTVAKGLSTLLHVPETCMLIEPPKLRSSVAALYWYRTGISNISEVSGDTPEWIQRLTIIQHGIDDSNFDLSDMVQWAFDNDLTDESDMAFQYAQLADCNSNAAAFLKSNCQAKYLKDCAVMCRHYKRAQKRQMNMSQWIKYRCSKIDEGGDWRPIVQFLRYQGVEFISFLRALKEFLKGTPKKNCILLYGPANTGKSYFGMSFIHFLQGAIISFVNSNSHFWLEPLADTKVAMLDDATHTCWTYFDNYMRNALDGNPISIDRKHKPLLQLKCPPILLTSNIDPAKDNKWPYLESRVTVFTFPHAFPFDKNGNPVYEINDKNWKCFFERTWSRLDLGGGGGRAHYNIVTFCCKCDSTLRLCVQSTHVDIRTLEDLLMGTLGIVCPICSQKPTLHEYMLDLQPETTDLYGYQQLGGGGGRHTMLCMCCKCEARIKLVVESSADDLRAFQQLFLNTLSFVCPWCASQQTLQDIVLHLEPQNEIPVDLLGHQQLSDSEEENDEI

SEQ ID NO: 92 - protein, 2401 aa, artificial
  synthetic polypeptide
MAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTGKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLAPVKQTLNFDLLKLAGDVESNPGPKQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTGKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLDLAPVKQTLNFDLLKLAGDVESNPGPGKAAMLGKFKELYGVSFMELIRPFQSNKSTCTDWCVAAFGVTGTVAEGFKTLLQPYCLYCHLQSLACSWGMVMLMLVRFKCAKNRITIEKLLEKLLCISTNCMLIQPPKLRSTAAALYWYRTGMSNISDVYGETPEWIERQTVLQHSFNDTTFDLSQMVQWAYDNDVMDDSEIAYKYAQLADSDSNACAFLKSNSQAKIVKDCGTMCRHYKRAEKRQMSMGQWIKSRCDKVSDEGDWRDIVKFLRYQQIEFVSFLSALKLFLKGVPKKNCILIHGAPNTGKSYFGMSLISFLQGCIISYANSKSHFWLQPLADAKIGMLDDATTPCWHYIDNYLRNALDGNPVSIDVKHKALMQLKCPPLLITSNINAGKDDRWPYLHSRLVVFTFPNPFPFDKNGNPVYELSDKNWKSFFSRTWCRLNLAPVKQTLNFDLLKLAGDVESNPGPTKANILYKFKEAYGISFMELVRPFKSDKTSCTDWCITGYGISPSVAESLKVLIKQHSLYTHLQCLTCDRGIIILLLIRFRCSKNRLTVAKLMSNLLSIPETCMVIEPPKLRSQTCALYWFRTAMSNISDVQGTTPEWIDRLTVLQHSFNDNIFDLSEMVQWAYDNELTDDSDIAYYYAQLADSNSNAAAFLKSNSQAKIVKDCGIMCRHYKKAEKRKMSIGQWIQSRCEKTNDGGNWRPIVQLLRYQNIEFTAFLGAFKKFLKGIPKKSCMLICGPANTGKSYFGMSLIQFLKGCVISCVNSKSHFWLQPLSDAKIGMIDDVTPISWTYIDDYMRNALDGNEISIDVKHRALVQLKCPPLLLTSNTNAGTDSRWPYLHSRLTVFEFKNPFPFDENGNPVYAINDENWKSFFSRTWCKLDLAPVKQTLNFDLLKLAGDVESNPGPKKAAMLAVFKDIYGLSFTDLVRNFKSDKTTCTDWVMAIFGVNPTVAEGFKTLIKPATLYAHIQCLDCKWGVLILALLRYKCGKNRLTVAKGLSTLLHVPETCMLIEPPKLRSSVAALYWYRTGISNISEVSGDTPEWIQRLTIIQHGIDDSNFDLSDMVQWAFDNDLTDESDMAFQYAQLADCNSNAAAFLKSNCQAKYLKDCAVMCRHYKRAQKRQMNMSQWIKYRCSKIDEGGDWRPIVQFLRYQGVEFISFLRALKEFLKGTPKKNCILLYGPANTGKSYFGMSFIHFLQGAIISFVNSNSHFWLEPLADTKVAMLDDATHTCWTYFDNYMRNALDGNPISIDRKHKPLLQLKCPPILLTSNIDPAKDNKWPYLESRVTVFTFPHAFPFDKNGNPVYEINDKNWKCFFERTWSRLDLAPVKQTLNFDLLKLAGDVESNPGPRAHYNIVTFCCKCDSTLRLCVQSTHVDIRTLEDLLMGTLGIVCPICSQKPTLHEYMLDLQPETTDLYGYQQLAPVKQTLNFDLLKLAGDVESNPGPRHTMLCMCCKCEARIKLVVESSADDLRAFQQLFLNTLSFVCPWCASQQTLQDIVLHLEPQNEIPVDLLGHQQLSDSEEENDEID

SEQ ID NO: 93 - protein, 2335 aa, artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIKKHGYTVEVQFDGDICNTMHYTNWTHIYICEEASVTVVEGQVDYYGLYYVHEGIRTYFVQFKDDAEKYSKNKVWEVHAGGQVILCPTSVFSGGTGGSTTPIVHLKGDANTLKCLRYRFKKHCTLYTAVSSTWHWTGHNVKHKSAIVTLTYDSEWQRDQFLSQVKIPKTITVSTGFMSIGGGGGMQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFKKGGQTVQVYFDGNKDNCMTYVAWDSVYYMTDAGTWDKTATCVSHRGLYYVKEGYNTFYIEFKSECEKYGNTGTWEVHFGNNVIDCNDSMCSGGTGGSTTPIIHLKGDRNSLKCLRYRLRKHSDHYRDISSTWHWTGAGNEKTGILTVTYHSETQRTKFLNTVAIPDSVQILVGYMTMGGGGGMEEISARLNAVQEKILDLYEADKTDLPSQIEHWKLIRMECALLYTAKQMGFSHLCHQVVPSLLASKTKAFQVIELQMALETLSKSQYSTSQWTLQQTSLEVWLCEPPKCFKKQGETVTVQYDNDKKNTMDYTNWGEIYIIEEDTCTMVTGKVDYIGMYYIHNCEKVYFKYFKEDAAKYSKTQMWEVHVGGQVIVCPTSISSGGTGGSVAPIVHLKGESNSLKCLRYRLKPYKELYSSMSSTWHWTSDNKNSKNGIVTVTFVTEQQQQMFLGTVKIPPTVQISTGFMTLGGGGGMESIPARLNAVQEKILDLYEADSNDLNAQIEHWKLTRMECVLFYKAKELGITHIGHQVVPPMAVSKAKACQAIELQLALEALNKTQYSTDGWTLQQTSLEMWRAEPQKYFKKHGYTITVQYDNDKNNTMDYTNWKEIYLLGECECTIVEGQVDYYGLYYWCDGEKIYFVKFSNDAKQYCVTGVWEVHVGGQVIVCPASVSSGGTGGSTAPIIHLKGDPNSLKCLRYRVKTHKSLYVQISSTWHWTSNECTNNKLGIVTITYSDETQRQQFLKTVKIPNTVQVIQGVMSLGGGGGMEEISARLSAVQDKILDIYEADKNDLTSQIEHWKLIRMECAIMYTARQMGISHLCHQVVPSLVASKTKAFQVIELQMALETLNASPYKTDEWTLQQTSLEVWLSEPQKCFKKKGITVTVQYDNDKANTMDYTNWSEIYIIEETTCTLVAGEVDYVGLYYIHGNEKTYFKYFKEDAKKYSKTQLWEVHVGSRVIVCPTSIPSGGTGGSVSPIVHLKGDPNSLKCLRYRLKPFKDLYCNMSSTWHWTSDDKGDKVGIVTVTYTTETQRQLFLNTVKIPPTVQISTGVMSLGGGGGDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSGGGGGDPTRRPYKLPDLCTELNTSLQDIEITCVYCKTVLELTEVFEFAFKDLFVVYRDSIPHAACHKCIDFYSRIRELRHYSDSVYGDTLEKLTNTGLYNLLIRCLRCQKPLNPAEKLRHLNEKRRFHNIAGHYRGQCHSCCNRAGGGGGNPAERPRKLHELSSALEIPYDELRLNCVYCKGQLTETEVLDFAFTDLTIVYRDDTPHGVCTKCLRFYSKVSEFRWYRYSVYGTTLEKLTNKGICDLLIRCITCQRPLCPEEKQRHLDKKKRFHNIGGRWTGRCIACWRRPGGGGGDPKQRPYKLPDLCTELNTSLQDVSIACVYCKATLERTEVYQFAFKDLCIVYRDCIAYAACHKCIDFYSRIRELRYYSNSVYGETLEKITNTELYNLLIRCLRCQKPLNPAEKRRHLKDKRRFHSIAGQYRGQCNTCCDQAGGGGGDPATRPRTLHELCEVLEESVHEIRLQCVQCKKELQRREVYKFLFTDLRIVYRDNNPYGVCIMCLRFLSKISEYRHYQYSLYGKTLEERVKKPLSEITIRCIICQTPLCPEEKERHVNANKRFHNIMGRWTGRCSECWRPRGGGGGDAEEKPRTLHDLCQALETSVHEIELKCVECKKTLQRSEVYDFVFADLRIVYRDGNPFAVCKVCLRLLSKISEYRHYNYSLYGDTLEQTLKKCLNEILIRCIICQRPLCPQEKKRHVDLNKRFHNISGRWTGRCAVCWRPR

SEQ ID NO: 94 - protein, 2524 aa, artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIKKHGYTVEVQFDGDICNTMHYTNWTHIYICEEASVTVVEGQVDYYGLYYVHEGIRTYFVQFKDDAEKYSKNKVWEVHAGGQVILCPTSVFSGGTGGSTTPIVHLKGDANTLKCLRYRFKKHCTLYTAVSSTWHWTGHNVKHKSAIVTLTYDSEWQRDQFLSQVKIPKTITVSTGFMSIAPVKQTLNFDLLKLAGDVESNPGPMQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFKKGGQTVQVYFDGNKDNCMTYVAWDSVYYMTDAGTWDKTATCVSHRGLYYVKEGYNTFYIEFKSECEKYGNTGTWEVHFGNNVIDCNDSMCSGGTGGSTTPIIHLKGDRNSLKCLRYRLRKHSDHYRDISSTWHWTGAGNEKTGILTVTYHSETQRTKFLNTVAIPDSVQILVGYMTMAPVKQTLNFDLLKLAGDVESNPGPMEEISARLNAVQEKILDLYEADKTDLPSQIEHKLIRMECALLYTAKQMGFSHLCHQVVPSLLASKTKAFQVIELQMALETLSKSQYSTSQWTLQQTSLEVWLCEPPKCFKKQGETVTVQYDNDKKNTMDYTNWGEIYIIEEDTCTMVTGKVDYIGMYYIHNCEKVYFKYFKEDAAKYSKTQMWEVHVGGQVIVCPTSISSGGTGGSVAPIVHLKGESNSLKCLRYRLKPYKELYSSMSSTWHWTSDNKNSKNGIVTVTFVTEQQQQMFLGTVKIPPTVQISTGFMTLAPVKQTLNFDLLKLAGDVESNPGPMESIPARLNAVQEKILDLYEADSNDLNAQIEHWKLTRMECVLFYKAKELGITHIGHQVVPPMAVSKAKACQAIELQLALEALNKTQYSTDGWTLQQTSLEMWRAEPQKYFKKHGYTITVQYDNDKNNTMDYTNWKEIYLLGECECTIVEGQVDYYGLYYWCDGEKIYFVKFSNDAKQYCVTGVWEVHVGGQVIVCPASVSSGGTGGSTAPIIHLKGDPNSLKCLRYRVKTHKSLYVQISSTWHWTSNECTNNKLGIVTITYSDETQRQQFLKTVKIPNTVQVIQGVMSLAPVKQTLNFDLLKLAGDVESNPGPMEEISARLSAVQDKILDIYEADKNDLTSQIEHWKLIRMECAIMYTARQMGISHLCHQVVPSLVASKTKAFQVIELQMALETLNASPYKTDEWTLQQTSLEVWLSEPQKCFKKKGITVTVQYDNDKANTMDYTNWSEIYIIEETTCTLVAGEVDYVGLYYIHGNEKTYFKYFKEDAKKYSKTQLWEVHVGSRVIVCPTSIPSGGTGGSVSPIVHLKGDPNSLKCLRYRLKPFKDLYCNMSSTWHWTSDDKGDKVGIVTVTYTTETQRQLFLNTVKIPPTVQISTGVMSLAPVKQTLNFDLLKLAGDVESNPGPDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSAPVKQTLNFDLLKLAGDVESNPGPDPTRRPYKLPDLCTELNTSLQDIEITCVYCKTVLELTEVFEFAFKDLFVVYRDSIPHAACHKCIDFYSRIRELRHYSDSVYGDTLEKLTNTGLYNLLIRCLRCQKPLNPAEKLRHLNEKRRFHNIAGHYRGQCHSCCNRAAPVKQTLNFDLLKLAGDVESNPGPNPAERPRKLHELSSALEIPYDELRLNCVYCKGQLTETEVLDFAFTDLTIVYRDDTPHGVCTKCLRFYSKVSEFRWYRYSVYGTTLEKLTNKGICDLLIRCITCQRPLCPEEKQRHLDKKKRFHNIGGRWTGRCIACWRRPAPVKQTLNFDLLKLAGDVESNPGPDPKQRPYKLPDLCTELNTSLQDVSIACVYCKATLERTEVYQFAFKDLCIVYRDCIAYAACHKCIDFYSRIRELRYYSNSVYGETLEKITNTELYNLLIRCLRCQKPLNPAEKRRHLKDKRRFHSIAGQYRGQCNTCCDQAAPVKQTLNFDLLKLAGDVESNPGPDPATRPRTLHELCEVLEESVHEIRLQCVQCKKELQRREVYKFLFTDLRIVYRDNNPYGVCIMCLRFLSKISEYRHYQYSLYGKTLEERVKKPLSEITIRCIICQTPLCPEEKERHVNANKRFHNIMGRWTGRCSECWRPRAPVKQTLNFDLLKLAGDVESNPGPDAEEKPRTLHDLCQALETSVHEIELKCVECKKTLQRSEVYDFVFADLRIVYRDGNPFAVCKVCLRLLSKISEYRHYNYSLYGDTLEQTLKKCLNEILIRCIICQRPLCPQEKKRHVDLNKRFHNISGRWTGRCAVCWRPR

SEQ ID NO: 95 - protein, 6 aa, artificial
  linker
GGTGGS

SEQ ID NO: 96 - protein, 8 aa, artificial
  linker
  Misc (2)..(2): Xaa="Val or Ile".
  Misc (4)..(4): Xaa="Ala" or "Arg" or "Asn" or "Asp" or "Cys" or "Gln" or "Glu" or "Gly" or "His" or "Ile" or "Leu" or "Lys" or "Met" or "Phe" or " Pro" or "Ser" or "Thr" or "Trp" or "Tyr" or "Val"
DXEXNPGP

SEQ ID NO: 97 - protein, 109 aa, artificial
  synthetic polypeptide
CSSHSSNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFET

SEQ ID NO: 98 - protein, 420 aa, artificial
  synthetic polypeptide
ANAAMLAKFKELFGISFTELIRPFKSDKSTCTDWCVAAFGIAPSVAESLKTLIKPYCLYIHIQCLSCSWGMVILALLRFKCAKNRTTIEKLLSKLLCISAASMLIQPPKLRSTPAALYWFKTAMSNISEVDGETPEWIQRQTVLQHSFNDAIFDLSEMVQWAYDNDFIDDSDIAYKYAQLAETNSNACAFLKSNSQAKIVKDCATMCRHYKRAEKREMTMSQWIKRRCEKVDDDGDWRDIVRFLRYQQVDFVAFLSALKNFLHGVPKKNCILIYGAPNTGKSLFGMSLMHFLQGAIISYVNSKSHFWLQPLYDAKIAMLDDATSPCWAYIDQYLRNALDGNPISLDVKHKALVQLKCPPLLITSNINAGKDDRWPYLHSRVVVFTFHNEFPFDKNGNPVYGLNDKNWKSFFSRTWCRLNL

SEQ ID NO: 99 - protein, 140 aa, artificial
  synthetic polypeptide
DPAERPYKLHDLCNEVEESIHEICLNCVYCKQELQRSEVYDFACYDLCIVYREGQPYGVCMKCLKFYSKISEYRWYRYSVYGETLEKQCNKQLCHLLIRCITCQKPLCPVEKQRHLEEKKRFHNIGGRWTGRCMSCWKPT

SEQ ID NO: 100 - protein, 286 aa, artificial
  synthetic polypeptide
MQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFKKGGQTVQVYFDGNKDNCMTYVAWDSVYYMTDAGTWDKTATCVSHRGLYYVKEGYNTFYIEFKSECEKYGNTGTWEVHFGNNVIDCNDSMCSTTPIIHLKGDRNSLKCLRYRLRKHSDHYRDISSTWHWTGAGNEKTGILTVTYHSETQRTKFLNTVAIPDSVQILVGYMTM

SEQ ID NO: 101 - protein, 287 aa, artificial
  synthetic polypeptide
MKMQTPKESLSERLSALQDKILDHYENDSKDINSQISYWQLIRLENAILFTAREHGITKLNHQVVPPINISKSKAHKAIELQMALKGLAQSKYNNEEWTLQDTCEELWNTEPSQCFKKGGKTVHVYFDGNKDNCMNYVVWDSIYYITETGIWDKTAACVSYWGVYYIKDGDTTYYVQFKSECEKYGNSNTWEVQYGGNVIDCNDSMCSTTPIIHLKGDKNSLKCLRYRLRKYADHYSEISSTWHWTGCNKNTGILTVTYNSEVQRNTFLDVVTIPNSVQISVGYMTI

SEQ ID NO: 102 - protein, 283 aa, artificial
  synthetic polypeptide
MMETLSQRLSVCQDKILEHYETDSTCLSDHIQYWKLIRLECAVFYKAREMGIKTLNHQVVPTQAISKAKAMQAIELQLMLETLNTTEYSTETWTLQETSIELYTTVPQGCFKKHGVTVEVQFDGDKQNTMHYTNWTHIYILEDSICTVVKGLVNYKGIYYVHQGVETYYVTFREEAKKYGKKNIWEVHVGGQVIVCPESVFSTTPIVHLKGDANTLKCLRYRLGKYKALYQDASSTWRWTCTNDKKQIAIVTLTYTTEYQRDKFLTTVKIPNTVTVSKGYMSI

SEQ ID NO: 103 - protein, 282 aa, artificial
  synthetic polypeptide
MEEISARLNAVQEKILDLYEADKTDLPSQIEHWKLIRMECALLYTAKQMGFSHLCHQVVPSLLASKTKAFQVIELQMALETLSKSQYSTSQWTLQQTSLEVWLCEPPKCFKKQGETVTVQYDNDKKNTMDYTNWGEIYIIEEDTCTMVTGKVDYIGMYYIHNCEKVYFKYFKEDAAKYSKTQMWEVHVGGQVIVCPTSISSVAPIVHLKGESNSLKCLRYRLKPYKELYSSMSSTWHWTSDNKNSKNGIVTVTFVTEQQQQMFLGTVKIPPTVQISTGFMTL

SEQ ID NO: 104 - protein, 207 aa, artificial
  synthetic polypeptide
KFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYLFGMSLMKFLQGSVICFVNSKSHFWLQPLADAKIGMLDDATVPCWNYIDDNLRNALDGNLVSMDVKHRPLVQLKCPPLLITSNINAGTDSRWPYLH

SEQ ID NO: 105 - protein, 207 aa, artificial
  synthetic polypeptide
VFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLE

SEQ ID NO: 106 - protein, 207 aa, artificial
  synthetic polypeptide
VFKDIYGLSFTDLVRNFKSDKTTCTDWVMAIFGVNPTVAEGFKTLIKPATLYAHIQCLDCKWGVLILALLRYKCGKNRLTVAKGLSTLLHVPETCMLIEPPKLRSSVAALYYFGMSFIHFLQGAIISFVNSNSHFWLEPLADTKVAMLDDATHTCWTYFDNYMRNALDGNPISIDRKHKPLLQLKCPPILLTSNIDPAKDNKWPYLE

SEQ ID NO: 107 - protein, 207 aa, artificial
  synthetic polypeptide
KFKELFGISFTELIRPFKSDKSTCTDWCVAAFGIAPSVAESLKTLIKPYCLYIHIQCLSCSWGMVILALLRFKCAKNRTTIEKLLSKLLCISAASMLIQPPKLRSTPAALYLFGMSLMHFLQGAIISYVNSKSHFWLQPLYDAKIAMLDDATSPCWAYIDQYLRNALDGNPISLDVKHKALVQLKCPPLLITSNINAGKDDRWPYLH

SEQ ID NO: 108 - protein, 207 aa, artificial
  synthetic polypeptide
KFKEAYGISFMELVRPFKSDKTSCTDWCITGYGISPSVAESLKVLIKQHSLYTHLQCLTCDRGIIILLLIRFRCSKNRLTVAKLMSNLLSIPETCMVIEPPKLRSQTCALYYFGMSLIQFLKGCVISCVNSKSHFWLQPLSDAKIGMIDDVTPISWTYIDDYMRNALDGNEISIDVKHRALVQLKCPPLLLTSNTNAGTDSRWPYLH

SEQ ID NO: 109 - protein, 91 aa, artificial
  synthetic polypeptide
PTLAVSKNKALQAIELQLTLETIYNSQYSNEKWTLQDVSLEVYLTAPTGCIKKHGYTVEVQFDGDICNTMHYTNWTHIYICEEASVTVVEG

SEQ ID NO: 110 - protein, 92 aa, artificial
  synthetic polypeptide
PAYNISKSKAHKAIELQMALQGLAQSAYKTEDWTLQDTCEELWNTEPTHCFKKGGQTVQVYFDGNKDNCMTYVAWDSVYYMTDAGTWDKTAT

SEQ ID NO: 111 - protein, 92 aa, artificial
  synthetic polypeptide
PPINISKSKAHKAIELQMALKGLAQSKYNNEEWTLQDTCEELWNTEPSQCFKKGGKTVHVYFDGNKDNCMNYVVWDSIYYITETGIWDKTAA

SEQ ID NO: 112 - protein, 91 aa, artificial
  synthetic polypeptide
PTQAISKAKAMQAIELQLMLETLNTTEYSTETWTLQETSIELYTTVPQGCFKKHGVTVEVQFDGDKQNTMHYTNWTHIYILEDSICTVVKG

SEQ ID NO: 113 - protein, 91 aa, artificial
  synthetic polypeptide
PSLLASKTKAFQVIELQMALETLSKSQYSTSQWTLQQTSLEVWLCEPPKCFKKQGETVTVQYDNDKKNTMDYTNWGEIYIIEEDTCTMVTG

SEQ ID NO: 114 - DNA, 1950 bp, artificial
  synthetic polynucleotide
atggccgaccccgccggaacaaacggcgaagagggaacaggctgtaacggctggttctatgtggaagctgtcgtcgaaaagaaaaccggcgatgccattagcgatgacgagaatgagaacgacagcgatacaggagaagatctggtggattttatcgtgaacgataacgactacctcacacaggccgaaacagagaccgctcatgccctcttcacagctcaagaggctaagcagcacagagatgctgtgcaagtcctgaagaggaagtacctcgtcagccctctgtccgacataagcggatgcgtcgacaacaatatcagccccaggctcaaggccatttgcattgagaagcagagcagagccgctaagagaaggctgttcgagtccgaggattccggctacggaaataccgaagtggagacccaacaaatgctccaggtcgagggcagacatgagaccgagaccccttgtagccagtactccggcggctccggaggcggatgctcccaatacagctccggaagcggcggagagggagtcagcgagaggcacaccatctgtcagacccccctgaccaacatcctgaacgtgctgaaaacaagcaacgctaaggccgccatgctcgccaaattcaaggagctctacggcgtctcctttagcgagctcgtgaggcccttcaaaagcaataagtccacctgttgcgactggtgcatcgccgcctttggcctgaccccctccatcgccgacagcatcaagaccctcctccagcagtactgcctctacctccacatccagtccctcgcctgttcctggggcatggtggtcctcctcctcgtgagatacaagtgcggcaaaaacagggaaacaatcgagaagctcctcagcaaactcctctgcgtgagccccatgtgtatgatgattgagcctcccaagctgaggagcacagctgccgctctgtattggtacaagacaggcatcagcaatatctccgaggtctacggcgacacacccgaatggattcagaggcagaccgtcctccagcatagctttaatgactgcacatttgagctgtcccagatggtccaatgggcctacgataatgacatagtcgacgacagcgagatcgcttacaaatacgcccaactggccgacaccaacagcaatgccagcgccttcctgaagagcaatagccaggctaaaattgtgaaagattgcgctacaatgtgtagacactacaagagggccgaaaagaagcagatgagcatgagccagtggatcaaatatagatgcgacagggtcgatgacggcggcgactggaagcagatcgtgatgtttctgagataccagggcgtcgagttcatgagctttctgaccgccctcaaaaggttcctgcagggaattcccaagaagaactgcatcctcctgtatggcgccgctaacacaggaaagagcctgttcggaatgagcctgatgaagttcctccagggcagcgtcatctgcttcgtgaactccaaaagccacttctggctccaacccctggctgacgccaagatcggcatgctggatgacgctacagtcccctgctggaactacattgacgacaacctgaggaatgctctggatggaaacctggtcagcatggacgtgaagcacagacctctggtgcagctgaaatgcccccccctgctgattacatccaatatcaatgctggaaccgactccaggtggccctacctccacaatagactcgtcgtgttcaccttccccaacgagttccctttcgacgaaaacggaaaccccgtgtacgagctcaacgacaaaaactggaaaagcttcttcagcagaacctggtccaggctgagcctgcacgaggatgaggacaaagagaacgacggcgattccctgcctaccttcaagtgcgtcagcggccaaaataccaacaccctgtaa

SEQ ID NO: 115 - DNA, 1098 bp, artificial
  synthetic polynucleotide
atggagaccctctgccagaggctgaacgtgtgtcaggacaagatcctcacccattacgaaaacgattccaccgacctgagagaccatatcgattactggaagcatatgagactcgagtgcgccatctattacaaggccagggagatgggcttcaaacacatcaaccatcaggtcgtgcccaccctggctgtcagcaagaacaaggctctgcaggccatcgagctccagctgacactcgaaaccatctacaactcccagtattccaacgagaaatggaccctccaggacgtcagcctcgaagtgtatctcaccgcccccaccggctgtatcaagaagcatggatacacagtggaggtccagttcgacggcgacatctgtaacaccatgcactacacaaactggacccacatctacatctgcgaggaagctagcgtcacagtcgtggagggacaagtggactattacggcctgtactatgtgcacgagggcatcaggacctacttcgtccaattcaaagacgacgccgaaaagtatagcaaaaataaggtgtgggaggtgcacgctggcggccaagtgattctctgccccaccagcgtgttttccagcaacgaagtgagcagccccgaaatcatcaggcagcacctcgccaaccatcctgctgctacccacaccaaggccgtggccctgggcacagaggaaacccagaccaccatccagaggcccaggtccgagcctgacaccggcaatccctgtcacacaaccaagctgctccacagggattccgtcgattccgctcccatcctcaccgccttcaacagcagccataagggcaggattaactgcaacagcaacacaacccctatcgtgcacctcaaaggcgatgctaacaccctcaaatgcctgaggtacaggttcaaaaagcactgcacactctacaccgccgtgagctccacctggcattggaccggccataatgtcaaacacaagagcgccatcgtgaccctcacctatgattccgagtggcaaagagaccagttcctgagccaggtcaagatccccaagacaatcaccgtgagcaccggcttcatgtccatctaa

SEQ ID NO: 116 - DNA, 477 bp, artificial
  synthetic polynucleotide
atgcaccagaagaggacagctatgtttcaggacccccaggaaagacctagaaagctgcctcagctgtgcaccgagctgcaaacaaccatccacgacatcatcctcgagtgcgtgtattgcaagcagcagctgctgagaagggaggtctacgactttgccttcagggacctctgcattgtctacagggatggcaacccctacgccgtctgcgataaatgtctcaagttctactccaaaatctccgaatacagacactactgttattccctgtacggcaccacactggagcaacaatacaacaagcccctgtgtgacctgctgattagatgcatcaattgtcagaagcccctgtgccctgaggaaaagcaaagacacctggataaaaagcaaagattccacaacattagaggcaggtggaccggaagatgtatgagctgctgcagatcctccaggaccagaagagaaacacagctctaa

SEQ ID NO: 117 - DNA, 2808 bp, artificial
  synthetic polynucleotide
atgggctgcaacggctggttttacgtggaggctgtggtggaaaagaagaccggcgacgccatcagcgatgacgagaatgaaaatgacagcgacaccggagaagacctcgtggacttcatcgtcaacgacaacgactatctcacccaggccgagacagagacagcccacgccctcttcaccgcccaggaagccaagcaacacagagacgctgtccaggtcctgaagaggaaatacttcaaggagctctacggcgtctcctttagcgagctcgtgaggcccttcaaaagcaataagtccacctgttgcgactggtgcatcgccgcctttggcctgaccccctccatcgccgacagcatcaagaccctcctccagcagtactgcctctacctccacatccagtccctcgcctgttcctggggcatggtggtcctcctcctcgtgagatacaagtgcggcaaaaacagggaaacaatcgagaagctcctcagcaaactcctctgcgtgagccccatgtgtatgatgattgagcctcccaagctgaggagcacagctgccgctctgtattggtacaagacaggcatcagcaatatctccgaggtctacggcgacacacccgaatggattcagaggcagaccgtcctccagcatagctttaatgactgcacatttgagctgtcccagatggtccaatgggcctacgataatgacatagtcgacgacagcgagatcgcttacaaatacgcccaactggccgacaccaacagcaatgccagcgccttcctgaagagcaatagccaggctaaaattgtgaaagattgcgctacaatgtgtagacactacaagagggccgaaaagaagcagatgagcatgagccagtggatcaaatatagatgcgacagggtcgatgacggcggcgactggaagcagatcgtgatgtttctgagataccagggcgtcgagttcatgagctttctgaccgccctcaaaaggttcctgcagggaattcccaagaagaactgcatcctcctgtatggcgccgctaacacaggaaagagcctgttcggaatgagcctgatgaagttcctccagggcagcgtcatctgcttcgtgaactccaaaagccacttctggctccaacccctggctgacgccaagatcggcatgctggatgacgctacagtcccctgctggaactacattgacgacaacctgaggaatgctctggatggaaacctggtcagcatggacgtgaagcacagacctctggtgcagctgaaatgcccccccctgctgattacatccaatatcaatgctggaaccgactccaggtggccctacctccacaatagactcgtcgtgttcaccttccccaacgagttccctttcgacgaaaacggaaaccccgtgtacgagctcaacgacaaaaactggaaaagcttcttcagcagaacctggtccaggctgagcctgatggaaaccctctgccagagactgaacgtgtgtcaggacaaaatcctgacacactacgaaaacgactccaccgacctcagagaccacatcgactactggaagcacatgaggctggagtgtgctatctactacaaggccagggagatgggcttcaaacacatcaatcatcaggtggtgcccaccctggctgtgagcaaaaacaaagccctccaggccatcgagctgcaactcaccctggagaccatttacaatagccaatacagcaatgaaaagtggaccctccaagacgtgagcctggaggtgtacctcaccgctcctaccggctgtatcaagaaacacggctacaccgtggaggtgcagtttgatggcgacatctgcaacaccatgcactataccaactggacccacatctacggccaggtcgattactacggcctctactacgtgcatgagggcattagaacctacttcgtgcagttcaaagacgacgccgaaaagtatagcaaaaacaaggtgtgggaggtgcatgctggcggacaagtgatcctgtgtcctaccagcgtgttcagctccaacgaggtgtcctcccctgaaatcgactccgtggatagcgcccccatcctgacagccttcaatagctcccataagggaagaatcaactgcaattccaacaccacccccatcgtccatctgaagggcgatgccaataccctgaagtgcctgagatacaggttcaagaaacattgcaccctctacaccgccgtctcctccacatggcattggaccggccacaatgtcaagcataagtccgccatcgtgacactcacctacgattccgaatggcagagggaccagttcctgagccaggtcaaaatccccaaaacaatcaccgtgagcaccggcttcatgagcatcatgtttcaggacccccaggagaggcctaggaaactgccccagctgtgtaccgagctgcaaaccacaatccacgacatcatcctcgagtgcgtctactgcaaacagcaactcctcaggagggaggtctatgacttcgccttcagggacctgtgtattgtgtacagagacggcaacccttacgccgtgtgtgataagtgcctgaaattttacagcaaaatcagcgagtacaggcactattgttactccctgtacggcacaaccctggaacagcagtataacaaacctctctgcgacctgctcatcaggtgcattaattgccagaagcctctctgtcccgaggagaagcaaaggcacctggacaagaagcagaggttccacaacattaggggcagatggaccggaagatgcatgagctgctgctaa

SEQ ID NO: 118 - DNA, 3519 bp, artificial
  synthetic polynucleotide
atggccgaccccgccggaacaaacggcgaagagggaacaggctgtaacggctggttctatgtggaagctgtcgtcgaaaagaaaaccggcgatgccattagcgatgacgagaatgagaacgacagcgatacaggagaagatctggtggattttatcgtgaacgataacgactacctcacacaggccgaaacagagaccgctcatgccctcttcacagctcaagaggctaagcagcacagagatgctgtgcaagtcctgaagaggaagtacctcgtcagccctctgtccgacataagcggatgcgtcgacaacaatatcagccccaggctcaaggccatttgcattgagaagcagagcagagccgctaagagaaggctgttcgagtccgaggattccggctacggaaataccgaagtggagacccaacaaatgctccaggtcgagggcagacatgagaccgagaccccttgtagccagtactccggcggctccggaggcggatgctcccaatacagctccggaagcggcggagagggagtcagcgagaggcacaccatctgtcagacccccctgaccaacatcctgaacgtgctgaaaacaagcaacgctaaggccgccatgctcgccaaattcaaggagctctacggcgtctcctttagcgagctcgtgaggcccttcaaaagcaataagtccacctgttgcgactggtgcatcgccgcctttggcctgaccccctccatcgccgacagcatcaagaccctcctccagcagtactgcctctacctccacatccagtccctcgcctgttcctggggcatggtggtcctcctcctcgtgagatacaagtgcggcaaaaacagggaaacaatcgagaagctcctcagcaaactcctctgcgtgagccccatgtgtatgatgattgagcctcccaagctgaggagcacagctgccgctctgtattggtacaagacaggcatcagcaatatctccgaggtctacggcgacacacccgaatggattcagaggcagaccgtcctccagcatagctttaatgactgcacatttgagctgtcccagatggtccaatgggcctacgataatgacatagtcgacgacagcgagatcgcttacaaatacgcccaactggccgacaccaacagcaatgccagcgccttcctgaagagcaatagccaggctaaaattgtgaaagattgcgctacaatgtgtagacactacaagagggccgaaaagaagcagatgagcatgagccagtggatcaaatatagatgcgacagggtcgatgacggcggcgactggaagcagatcgtgatgtttctgagataccagggcgtcgagttcatgagctttctgaccgccctcaaaaggttcctgcagggaattcccaagaagaactgcatcctcctgtatggcgccgctaacacaggaaagagcctgttcggaatgagcctgatgaagttcctccagggcagcgtcatctgcttcgtgaactccaaaagccacttctggctccaacccctggctgacgccaagatcggcatgctggatgacgctacagtcccctgctggaactacattgacgacaacctgaggaatgctctggatggaaacctggtcagcatggacgtgaagcacagacctctggtgcagctgaaatgcccccccctgctgattacatccaatatcaatgctggaaccgactccaggtggccctacctccacaatagactcgtcgtgttcaccttccccaacgagttccctttcgacgaaaacggaaaccccgtgtacgagctcaacgacaaaaactggaaaagcttcttcagcagaacctggtccaggctgagcctgcacgaggatgaggacaaagagaacgacggcgattccctgcctaccttcaagtgcgtcagcggccaaaataccaacaccctgatggagaccctctgccagaggctgaacgtgtgtcaggacaagatcctcacccattacgaaaacgattccaccgacctgagagaccatatcgattactggaagcatatgagactcgagtgcgccatctattacaaggccagggagatgggcttcaaacacatcaaccatcaggtcgtgcccaccctggctgtcagcaagaacaaggctctgcaggccatcgagctccagctgacactcgaaaccatctacaactcccagtattccaacgagaaatggaccctccaggacgtcagcctcgaagtgtatctcaccgcccccaccggctgtatcaagaagcatggatacacagtggaggtccagttcgacggcgacatctgtaacaccatgcactacacaaactggacccacatctacatctgcgaggaagctagcgtcacagtcgtggagggacaagtggactattacggcctgtactatgtgcacgagggcatcaggacctacttcgtccaattcaaagacgacgccgaaaagtatagcaaaaataaggtgtgggaggtgcacgctggcggccaagtgattctctgccccaccagcgtgttttccagcaacgaagtgagcagccccgaaatcatcaggcagcacctcgccaaccatcctgctgctacccacaccaaggccgtggccctgggcacagaggaaacccagaccaccatccagaggcccaggtccgagcctgacaccggcaatccctgtcacacaaccaagctgctccacagggattccgtcgattccgctcccatcctcaccgccttcaacagcagccataagggcaggattaactgcaacagcaacacaacccctatcgtgcacctcaaaggcgatgctaacaccctcaaatgcctgaggtacaggttcaaaaagcactgcacactctacaccgccgtgagctccacctggcattggaccggccataatgtcaaacacaagagcgccatcgtgaccctcacctatgattccgagtggcaaagagaccagttcctgagccaggtcaagatccccaagacaatcaccgtgagcaccggcttcatgtccatcatgcaccagaagaggacagctatgtttcaggacccccaggaaagacctagaaagctgcctcagctgtgcaccgagctgcaaacaaccatccacgacatcatcctcgagtgcgtgtattgcaagcagcagctgctgagaagggaggtctacgactttgccttcagggacctctgcattgtctacagggatggcaacccctacgccgtctgcgataaatgtctcaagttctactccaaaatctccgaatacagacactactgttattccctgtacggcaccacactggagcaacaatacaacaagcccctgtgtgacctgctgattagatgcatcaattgtcagaagcccctgtgccctgaggaaaagcaaagacacctggataaaaagcaaagattccacaacattagaggcaggtggaccggaagatgtatgagctgctgcagatcctccaggaccagaagagaaacacagctctaa

SEQ ID NO: 119 - DNA, 7848 bp, artificial
  synthetic polynucleotide
atggaaacactgtgccagaggctgaacgtgtgtcaggataagatcctgacccattatgaaaatgactccaccgatctgagagaccatatcgactactggaagcacatgaggctggagtgcgccatctattacaaggctagggagatgggcttcaaacacatcaaccatcaagtggtgcccaccctcgctgtgtccaagaacaaagccctccaagccatcgaactccaactgacactcgaaacaatttataattcccagtacagcaatgaaaaatggaccctccaggacgtgtccctggaggtctacctgaccgctcctaccggctgtattgccaagcacggctacaccgtcgaagtccagttcgatggagacatctgcaatacaatgcattataccaactggacccatatttatatttgcgaagaagcctccgtgacagtcgtcgagggacaggtcgattattacggcctctattacgtccacgagggaattaggacatactttgtccagtttaaagacgacgccgagaaatactccaagaacaaggtgtgggaagttcatgctggcggccaagtgattctgtgccctaccagcgtgttttccggaggaaccggcggaagcaccacacccatcgtgcacctcaagggcgatgccaacaccctgaagtgtctcaggtacaggtttaaaaagcattgcacactctatacagccgtgagcagcacctggcactggaccggccacaacgtcaaacacaagagcgctatcgtcaccctcacatacgacagcgagtggcagagggaccagtttctcagccaagtgaagattcctaaaacaatcacagtgagcacaggctttatgagcatcggcggcggcggcggtatgcaaacccctaaagaaacactgagcgagagactctcctgtgtccaggacaaaattatcgaccattacgaaaatgacagcaaggacatcgacagccagattcagtactggcagctgatcaggtgggagaatgctattttctttgccgccagagagcacggcatccaaacactgaaccatcaggtggtgcccgcttacaatatctccaagtccaaggcccacaaagccattgagctccagatggctctgcagggcctggcccagtccgcctacaaaaccgaggactggaccctgcaggacacatgtgaggagctgtggaacacagaacccacccactgcttcgctaagggcggccagaccgtccaagtgtattttgatggcaataaagataattgcatgacatatgtggcctgggacagcgtgtactatatgaccgacgctggcacctgggataagaccgctacatgcgtgagccacagaggcctgtactatgtcaaagagggatacaacaccttctacattgaattcaaaagcgagtgcgagaagtacggcaacaccggcacctgggaggtccacttcggaaacaatgtgatcgactgcaacgacagcatgtgttccggcggaacaggaggttctacaacccccattatccacctgaagggcgacagaaacagcctcaagtgcctcaggtataggctgagaaagcatagcgatcactatagagacatctcctccacatggcactggacaggcgccggcaacgaaaaaacaggaatcctgaccgtgacataccacagcgaaacacaaagaacaaagttcctgaacacagtggccatccccgattccgtgcagattctggtcggatacatgaccatgggaggaggaggcggcatggaaaccctctgtcataggctgaatgtctgccaggagaaaatcctcgattgctatgagctggacagcgacaaactggtggaccagattaactattggaccctgctcagatatgaggccgctatgttttacgctgccagagaaagaaacctgagaaccattaaccaccaagtggtccctgccacaacagtgtccaaacagaaggcctgtcaggctatcgaaatgcatatggccctccagtccctgaacaagagcgactacaacatggagccttggacaatgagagagacctgttacgaactctggtgcgtcgcccccaaacaatgcttcgccaagggcggaattacagtcaccgtgatcttcgatggcaacaaggacaatgccatggactacacctcctggaaattcatttatatctatgataacgacaagtgggtgaaaacaaacggaaatgtggactacaccggcatctactacaccgtcaattccaaaaaagagtactacgtgcagtttaaggatgaggctaaaatctacggcgcccagcagtgggaggtgtacatgtacggcaccgtgatcacctgccccgagtacgtgtcctccggaggcacaggcggcagcaccgccttcatcgtgcatctcaaaggcgataccaactgtctcaagtgtttcagatatagattcaccaagcacaagggcctctacaagaatgtcagcagcacatggcattggacctccaacacaaaaaccggcattgtcaccattgtgtttgacagcgcccaccagagagaaacatttatcaagaccatcaaagtgccccccagcgtcaccctgagcctcggaatcatgacactcggcggcggcggaggcgatccccaggagagacccagaaaactccctcagctctgcaccgagctccagacaacaattcacgacatcattctggagtgtgtgtattgtaaacaacagctgctcaggagagaggtgtatgacttcgccaggagggacctctgtatcgtgtatagagatggcaatccctacgctgtgtgcgataaatgcctcaagttttacagcaaaatcagcgagtacaggcactactgctacagcctctacggaacaaccctcgaacaacagtacaataaacctctctgtgatctcctgatcagaagaattaactgtcagaagcccctgtgtcccgaggagaaacagagacacctggataagaagcagaggtttcataacatcaggggcagatggaccggaagatgcatgtcctgttgtaggagctccggaggcggaggcggagatcctaccagaaggccttacaagctccccgatctgtgtacagagctcaacacctccctccaggacattgagattacatgtgtgtattgcaagaccgtcctggagctgaccgaggtcttcgaattcgccagaaaggacctgtttgtggtctacagggacagcatcccccacgccgcttgccataaatgtattgacttctacagcaggattagggaactgagacactacagcgactccgtgtatggcgacaccctggaaaagctcaccaacaccggcctgtataacctcctgatcaggagactgaggtgtcagaagcctctcaaccctgccgaaaagctgaggcacctcaacgaaaagagaaggtttcacaacatcgccggccattacagaggacaatgtcatagctgctgcaatagggctggcggaggaggcggagacgctgaagagaagcccaggacactgcatgacctgtgtcaagccctggaaacctccgtgcatgagatcgagctgaaatgcgtggagtgcaaaaagaccctgcagaggtccgaagtctacgactttgtcagagccgatctgaggatcgtctacagagatggaaaccctttcgccgtgtgcaaagtgtgtctgaggctgctgtccaagattagcgaatataggcattacaactatagcctgtacggcgatacactcgagcagaccctgaagaagtgtctgaacgagatcctgatcaggagaattatctgtcagaggcctctgtgtccccaagaaaagaaaagacacgtggatctgaataagaggttccataacatttccggaaggtggaccggcagatgcgctgtctgctggagacctagaggcggcggaggaggaaaccctcaggagaggcccaggagcctccaccatctgtccgaggtgctggaaattcccctgatcgacctcaggctgagctgcgtgtattgcaaaaaggaactgacaagggccgaagtgtacaatttcgccaggaccgagctgaaactggtgtacagggatgattttccttatgctgtgtgtagggtgtgtctgctgttctacagcaaggtcaggaaatataggtattacgactacagcgtctatggagccacactggagagcatcaccaagaaacaactgtgcgacctcctgatcaggaggtacaggtgtcagagccccctgacacccgaagaaaagcagctccattgcgataggaagaggagattccatctcatcgctcacggctggacaggcagctgtctcggatgttggaggcaaacaggcggaggcggaggaaactccgaggaaagaccttacaagctgcaagccctgtgcgatgaggtgaacatcagcatccacgatattaacctggactgcgtgttctgccagagaggactgtacaggtccgaagtgtacgacttcgccagatccgacctgtgtattgtctacagaaaggacaagccctacggcgtgtgtcagccctgcctcaagttctatagcaagattagggagtacagaagatacagacagagcgtgtatggcacaaccctggaaaacctgacaaacaaacagctctgcaacattctcattagaagaggcaaatgccaaaagcctctgtgccctctcgagaaacagaagcatgtcgatgagaagaagagattccatcagatcgctgaacagtggacaggcaggtgcaccagatgctggaggcctagcggaggaggaggaggcgctaaggccgctatgctcgccaaatttaaggaactgtatggagtctccttttccgagctggtcagacccttcaaaagcaacaagtccacctgctgtgattggtgtattgccgccttcggactgacaccttccattgctgacagcatcaagaccctgctccagcagtactgcctctatctgcatatccagtccctggcctgttcctggggcatggtcgtgctcctcctcgtgaggtataagtgcggcaagaacagggagaccattgagaagctgctcagcaagctgctgtgtgtctcccctatgtgtatgatgatcgagcctcccaagctcagaagcacagctgccgccctgtactggtataagaccggcatttccaacatcagcgaggtgtacggagatacccctgaatggattcagaggcaaacagtgctccagcactcctttaacgactgtaccttcgagctgagccagatggtccaatgggcctacgacaacgacattgtggatgatagcgagattgcctacaagtatgcccagctggccgacacaaatagcaacgctagcgcctttctgaaatccaactcccaggccaagatcgtgaaggactgtgccaccatgtgcaggcactacaagagggccgaaaaaaagcagatgtccatgtcccagtggattaagtatagatgtgacagagtggatgatggaggagactggaaacagattgtgatgttcctgcgttatcaaggcgtggaatttatgagcttcctgaccgccctgaagagatttctgcagggaatccctaagaagaactgcattctgctgtatggagccgccaatacagataaatccctctttggcatgagcctcatgaaattcctccagggcagcgtcatctgcttcgtcaacagcaagtcccatttctggctccagcccctcgctgacgccaaaatcggaatgctggatgatgctaccgtcccctgctggaactacatcgatgacaacctgagaaacgctctggatggcaacctcgtgtccatggatgtgaaacacaggcctctggtgcagctgaaatgtccccccctgctcatcacctccaacatcaacgctggaacagactccaggtggccttacctccacaataggctcgtggtgttcacattccccaacgagttcccctttgacgagaacggcaatcctgtctacgaactcaacgacaagaattggaagagcttcttctccaggacctggtccaggctgtccctgggaggcggaggaggaaagcagggagctatgctggccgtctttaaggacacatacggactcagcttcaccgatctggtgaggaatttcaagtccgacaagaccacctgcaccgactgggtcaccgctatctttggcgtcaatcccacaatcgctgagggatttaaaaccctcatccagccctttatcctgtacgctcacatccaatgtctcgactgtaaatggggcgtcctcatcctggccctcctgaggtataaatgcggcaagagcagactgaccgtggctaagggactctccaccctgctccacgtgcccgagacctgtatgctcattcaacctcccaaactgagaagcagcgtggctgccctgtattggtataggaccggcatctccaacatttccgaggtgatgggcgatacccccgagtggattcaaaggctgaccatcattcagcacggaattgacgacagcaattttgatctctccgagatggtgcagtgggccttcgataacgaactgacagacgaatccgacatggcttttgagtacgccctgctcgctgacagcaacagcaacgccgctgcctttctcaagtccaattgccaggctaagtacctgaaagactgcgctaccatgtgcaaacactataggagggcccagaaaaggcagatgaacatgtcccaatggatcagatttaggtgcagcaagattgatgagggcggcgactggagacccattgtgcagtttctgaggtatcaacaaattgagttcattacatttctgggagccctcaaaagcttcctgaagggaacccccaaaaaaaattgtctcgtgttctgtggacccgctaatacagataagagctacttcggaatgtcctttattcacttcatccaaggcgccgtcatcagcttcgtgaatagcacatcccacttttggctcgaacccctcaccgataccaaagtggctatgctggatgacgctacaaccacatgttggacctacttcgacacatatatgagaaacgccctcgacggcaaccccatctccattgacagaaagcacaagcccctgattcagctgaagtgcccccccatcctgctgacaaccaatatccaccctgccaaggacaacagatggccctacctggagtccagaatcaccgtgttcgagttccctaatgcttttccctttgacaaaaacggcaaccctgtctacgagattaacgataaaaattggaaatgtttctttgagaggacctggtccaggctcgacctgggcggaggaggaggaagggcccactataatatcgtcacattctgctgcaagtgtgactccacactgaggctgtgtgtgcagtccacccacgtcgacattaggacactcgaggacctgctgatgggcaccctgggaattgtgtgccctatttgttcccaaaagcccaccctccacgagtacatgctggacctgcagcctgagaccaccgacctctacggttatcaacagctcggcggcggcggcggaagacatacaatgctgtgtatgtgttgcaaatgtgaggccaggatcaagctggtcgtcgagtccagcgctgatgacctcagagcttttcagcaactgttcctgaatacactctcctttgtgtgcccttggtgcgctagccaacagaccctccaagacattgtgctgcacctcgagccccaaaatgagatccccgtggatctcctcggccaccaacaactgtccgattccgaagaggagaatgacgagatcgactga

SEQ ID NO: 120 - DNA, 4800 bp, artificial
  synthetic polynucleotide
atggaaacactgtgccagaggctgaacgtgtgtcaggataagatcctgacccattatgaaaatgactccaccgatctgagagaccatatcgactactggaagcacatgaggctggagtgcgccatctattacaaggctagggagatgggcttcaaacacatcaaccatcaagtggtgcccaccctcgctgtgtccaagaacaaagccctccaagccatcgaactccaactgacactcgaaacaatttataattcccagtacagcaatgaaaaatggaccctccaggacgtgtccctggaggtctacctgaccgctcctaccggctgtattgccaagcacggctacaccgtcgaagtccagttcgatggagacatctgcaatacaatgcattataccaactggacccatatttatatttgcgaagaagcctccgtgacagtcgtcgagggacaggtcgattattacggcctctattacgtccacgagggaattaggacatactttgtccagtttaaagacgacgccgagaaatactccaagaacaaggtgtgggaagttcatgctggcggccaagtgattctgtgccctaccagcgtgttttccggaggaaccggcggaagcaccacacccatcgtgcacctcaagggcgatgccaacaccctgaagtgtctcaggtacaggtttaaaaagcattgcacactctatacagccgtgagcagcacctggcactggaccggccacaacgtcaaacacaagagcgctatcgtcaccctcacatacgacagcgagtggcagagggaccagtttctcagccaagtgaagattcctaaaacaatcacagtgagcacaggctttatgagcatcggcggcggcggcggtatgcaaacccctaaagaaacactgagcgagagactctcctgtgtccaggacaaaattatcgaccattacgaaaatgacagcaaggacatcgacagccagattcagtactggcagctgatcaggtgggagaatgctattttctttgccgccagagagcacggcatccaaacactgaaccatcaggtggtgcccgcttacaatatctccaagtccaaggcccacaaagccattgagctccagatggctctgcagggcctggcccagtccgcctacaaaaccgaggactggaccctgcaggacacatgtgaggagctgtggaacacagaacccacccactgcttcgctaagggcggccagaccgtccaagtgtattttgatggcaataaagataattgcatgacatatgtggcctgggacagcgtgtactatatgaccgacgctggcacctgggataagaccgctacatgcgtgagccacagaggcctgtactatgtcaaagagggatacaacaccttctacattgaattcaaaagcgagtgcgagaagtacggcaacaccggcacctgggaggtccacttcggaaacaatgtgatcgactgcaacgacagcatgtgttccggcggaacaggaggttctacaacccccattatccacctgaagggcgacagaaacagcctcaagtgcctcaggtataggctgagaaagcatagcgatcactatagagacatctcctccacatggcactggacaggcgccggcaacgaaaaaacaggaatcctgaccgtgacataccacagcgaaacacaaagaacaaagttcctgaacacagtggccatccccgattccgtgcagattctggtcggatacatgaccatgggaggaggaggcggcatggaaaccctctgtcataggctgaatgtctgccaggagaaaatcctcgattgctatgagctggacagcgacaaactggtggaccagattaactattggaccctgctcagatatgaggccgctatgttttacgctgccagagaaagaaacctgagaaccattaaccaccaagtggtccctgccacaacagtgtccaaacagaaggcctgtcaggctatcgaaatgcatatggccctccagtccctgaacaagagcgactacaacatggagccttggacaatgagagagacctgttacgaactctggtgcgtcgcccccaaacaatgcttcgccaagggcggaattacagtcaccgtgatcttcgatggcaacaaggacaatgccatggactacacctcctggaaattcatttatatctatgataacgacaagtgggtgaaaacaaacggaaatgtggactacaccggcatctactacaccgtcaattccaaaaaagagtactacgtgcagtttaaggatgaggctaaaatctacggcgcccagcagtgggaggtgtacatgtacggcaccgtgatcacctgccccgagtacgtgtcctccggaggcacaggcggcagcaccgccttcatcgtgcatctcaaaggcgataccaactgtctcaagtgtttcagatatagattcaccaagcacaagggcctctacaagaatgtcagcagcacatggcattggacctccaacacaaaaaccggcattgtcaccattgtgtttgacagcgcccaccagagagaaacatttatcaagaccatcaaagtgccccccagcgtcaccctgagcctcggaatcatgacactcggcggcggcggaggcgatccccaggagagacccagaaaactccctcagctctgcaccgagctccagacaacaattcacgacatcattctggagtgtgtgtattgtaaacaacagctgctcaggagagaggtgtatgacttcgccaggagggacctctgtatcgtgtatagagatggcaatccctacgctgtgtgcgataaatgcctcaagttttacagcaaaatcagcgagtacaggcactactgctacagcctctacggaacaaccctcgaacaacagtacaataaacctctctgtgatctcctgatcagaagaattaactgtcagaagcccctgtgtcccgaggagaaacagagacacctggataagaagcagaggtttcataacatcaggggcagatggaccggaagatgcatgtcctgttgtaggagctccggaggcggaggcggagatcctaccagaaggccttacaagctccccgatctgtgtacagagctcaacacctccctccaggacattgagattacatgtgtgtattgcaagaccgtcctggagctgaccgaggtcttcgaattcgccagaaaggacctgtttgtggtctacagggacagcatcccccacgccgcttgccataaatgtattgacttctacagcaggattagggaactgagacactacagcgactccgtgtatggcgacaccctggaaaagctcaccaacaccggcctgtataacctcctgatcaggagactgaggtgtcagaagcctctcaaccctgccgaaaagctgaggcacctcaacgaaaagagaaggtttcacaacatcgccggccattacagaggacaatgtcatagctgctgcaatagggctggcggaggaggcggagacgctgaagagaagcccaggacactgcatgacctgtgtcaagccctggaaacctccgtgcatgagatcgagctgaaatgcgtggagtgcaaaaagaccctgcagaggtccgaagtctacgactttgtcagagccgatctgaggatcgtctacagagatggaaaccctttcgccgtgtgcaaagtgtgtctgaggctgctgtccaagattagcgaatataggcattacaactatagcctgtacggcgatacactcgagcagaccctgaagaagtgtctgaacgagatcctgatcaggagaattatctgtcagaggcctctgtgtccccaagaaaagaaaagacacgtggatctgaataagaggttccataacatttccggaaggtggaccggcagatgcgctgtctgctggagacctagaggcggcggaggaggaaaccctcaggagaggcccaggagcctccaccatctgtccgaggtgctggaaattcccctgatcgacctcaggctgagctgcgtgtattgcaaaaaggaactgacaagggccgaagtgtacaatttcgccaggaccgagctgaaactggtgtacagggatgattttccttatgctgtgtgtagggtgtgtctgctgttctacagcaaggtcaggaaatataggtattacgactacagcgtctatggagccacactggagagcatcaccaagaaacaactgtgcgacctcctgatcaggaggtacaggtgtcagagccccctgacacccgaagaaaagcagctccattgcgataggaagaggagattccatctcatcgctcacggctggacaggcagctgtctcggatgttggaggcaaacaggcggaggcggaggaaactccgaggaaagaccttacaagctgcaagccctgtgcgatgaggtgaacatcagcatccacgatattaacctggactgcgtgttctgccagagaggactgtacaggtccgaagtgtacgacttcgccagatccgacctgtgtattgtctacagaaaggacaagccctacggcgtgtgtcagccctgcctcaagttctatagcaagattagggagtacagaagatacagacagagcgtgtatggcacaaccctggaaaacctgacaaacaaacagctctgcaacattctcattagaagaggcaaatgccaaaagcctctgtgccctctcgagaaacagaagcatgtcgatgagaagaagagattccatcagatcgctgaacagtggacaggcaggtgcaccagatgctggaggcctagctga

SEQ ID NO: 121 - DNA, 3039 bp, artificial
  synthetic polynucleotide
atggctaaggccgctatgctcgccaaatttaaggaactgtatggagtctccttttccgagctggtcagacccttcaaaagcaacaagtccacctgctgtgattggtgtattgccgccttcggactgacaccttccattgctgacagcatcaagaccctgctccagcagtactgcctctatctgcatatccagtccctggcctgttcctggggcatggtcgtgctcctcctcgtgaggtataagtgcggcaagaacagggagaccattgagaagctgctcagcaagctgctgtgtgtctcccctatgtgtatgatgatcgagcctcccaagctcagaagcacagctgccgccctgtactggtataagaccggcatttccaacatcagcgaggtgtacggagatacccctgaatggattcagaggcaaacagtgctccagcactcctttaacgactgtaccttcgagctgagccagatggtccaatgggcctacgacaacgacattgtggatgatagcgagattgcctacaagtatgcccagctggccgacacaaatagcaacgctagcgcctttctgaaatccaactcccaggccaagatcgtgaaggactgtgccaccatgtgcaggcactacaagagggccgaaaaaaagcagatgtccatgtcccagtggattaagtatagatgtgacagagtggatgatggaggagactggaaacagattgtgatgttcctgcgttatcaaggcgtggaatttatgagcttcctgaccgccctgaagagatttctgcagggaatccctaagaagaactgcattctgctgtatggagccgccaatacagataaatccctctttggcatgagcctcatgaaattcctccagggcagcgtcatctgcttcgtcaacagcaagtcccatttctggctccagcccctcgctgacgccaaaatcggaatgctggatgatgctaccgtcccctgctggaactacatcgatgacaacctgagaaacgctctggatggcaacctcgtgtccatggatgtgaaacacaggcctctggtgcagctgaaatgtccccccctgctcatcacctccaacatcaacgctggaacagactccaggtggccttacctccacaataggctcgtggtgttcacattccccaacgagttcccctttgacgagaacggcaatcctgtctacgaactcaacgacaagaattggaagagcttcttctccaggacctggtccaggctgtccctgggaggcggaggaggaaagcagggagctatgctggccgtctttaaggacacatacggactcagcttcaccgatctggtgaggaatttcaagtccgacaagaccacctgcaccgactgggtcaccgctatctttggcgtcaatcccacaatcgctgagggatttaaaaccctcatccagccctttatcctgtacgctcacatccaatgtctcgactgtaaatggggcgtcctcatcctggccctcctgaggtataaatgcggcaagagcagactgaccgtggctaagggactctccaccctgctccacgtgcccgagacctgtatgctcattcaacctcccaaactgagaagcagcgtggctgccctgtattggtataggaccggcatctccaacatttccgaggtgatgggcgatacccccgagtggattcaaaggctgaccatcattcagcacggaattgacgacagcaattttgatctctccgagatggtgcagtgggccttcgataacgaactgacagacgaatccgacatggcttttgagtacgccctgctcgctgacagcaacagcaacgccgctgcctttctcaagtccaattgccaggctaagtacctgaaagactgcgctaccatgtgcaaacactataggagggcccagaaaaggcagatgaacatgtcccaatggatcagatttaggtgcagcaagattgatgagggcggcgactggagacccattgtgcagtttctgaggtatcaacaaattgagttcattacatttctgggagccctcaaaagcttcctgaagggaacccccaaaaaaaattgtctcgtgttctgtggacccgctaatacagataagagctacttcggaatgtcctttattcacttcatccaaggcgccgtcatcagcttcgtgaatagcacatcccacttttggctcgaacccctcaccgataccaaagtggctatgctggatgacgctacaaccacatgttggacctacttcgacacatatatgagaaacgccctcgacggcaaccccatctccattgacagaaagcacaagcccctgattcagctgaagtgcccccccatcctgctgacaaccaatatccaccctgccaaggacaacagatggccctacctggagtccagaatcaccgtgttcgagttccctaatgcttttccctttgacaaaaacggcaaccctgtctacgagattaacgataaaaattggaaatgtttctttgagaggacctggtccaggctcgacctgggcggaggaggaggaagggcccactataatatcgtcacattctgctgcaagtgtgactccacactgaggctgtgtgtgcagtccacccacgtcgacattaggacactcgaggacctgctgatgggcaccctgggaattgtgtgccctatttgttcccaaaagcccaccctccacgagtacatgctggacctgcagcctgagaccaccgacctctacggttatcaacagctcggcggcggcggcggaagacatacaatgctgtgtatgtgttgcaaatgtgaggccaggatcaagctggtcgtcgagtccagcgctgatgacctcagagcttttcagcaactgttcctgaatacactctcctttgtgtgcccttggtgcgctagccaacagaccctccaagacattgtgctgcacctcgagccccaaaatgagatccccgtggatctcctcggccaccaacaactgtccgattccgaagaggagaatgacgagatcgactga

SEQ ID NO: 122 - DNA, 5199 bp, artificial
  synthetic polynucleotide
atggaaaccctctgtcagaggctcaacgtgtgccaggacaagattctgacccattatgagaacgacagcaccgacctcagggaccatatcgattactggaagcacatgagactcgagtgtgccatctactacaaggctagagaaatgggcttcaagcatattaatcatcaagtggtgcccaccctggccgtctccaagaacaaagctctgcaggccattgagctccagctcaccctggagacaatctataattcccagtacagcaatgagaaatggacactgcaagacgtcagcctggaggtctacctcaccgcccccaccggctgtatcgccaaacatggctacacagtggaagtccaattcgacggagacatttgcaacaccatgcactataccaattggacccacatttacatttgcgaggaagcctccgtgacagtcgtcgagggccaggtggactactacggcctgtattatgtccacgagggcatcaggacctacttcgtccaattcaaagacgatgccgaaaagtactccaagaataaagtctgggaggtgcacgccggcggacaagtgatcctgtgccctacctccgtgttttccggaggcaccggaggcagcacaacacctattgtccacctgaaaggcgatgccaacacactcaaatgtctcaggtataggtttaaaaagcattgtaccctctataccgccgtgagcagcacctggcactggaccggacataatgtgaagcacaagtccgctatcgtgaccctgacctacgattccgaatggcaaagggaccagttcctctcccaggtgaagatccccaaaacaatcaccgtcagcaccggattcatgagcatcgcccctgtgaagcagaccctgaacttcgacctgctgaagctggccggcgacgtggagagcaatcccggccctatgcagacacccaaggagacactgagcgaaaggctgagctgcgtgcaggataagattatcgaccattacgaaaacgactccaaggacatcgacagccagattcagtattggcagctcattagatgggaaaacgctatcttcttcgccgccagggaacacggaattcagaccctgaaccaccaggtggtccctgcctacaatatcagcaagtccaaggcccacaaagctatcgaactccagatggctctgcagggcctggcccagtccgcctacaagacagaagactggaccctgcaagatacatgcgaggaactctggaataccgagcccacccactgttttgccaagggcggacaaaccgtgcaggtctactttgatggaaacaaagataactgtatgacatatgtggcttgggacagcgtgtattatatgaccgacgctggcacctgggacaaaacagctacctgcgtgagccacaggggcctgtactatgtgaaggagggatataacaccttctacatcgaattcaagagcgagtgtgagaagtacggcaacacaggaacatgggaagtgcatttcggcaataacgtgattgactgcaacgattccatgtgcagcggcggaacaggcggttctaccacccctatcatccacctgaagggcgacaggaactccctgaagtgcctcaggtacaggctgaggaagcacagcgatcactatagggacatttccagcacatggcactggacaggcgccggaaacgagaagacaggcattctgaccgtcacctatcacagcgaaacacagagaaccaagtttctgaatacagtcgccattcccgacagcgtgcaaattctggtcggctacatgaccatggcccctgtgaagcagaccctgaacttcgacctgctgaagctggccggcgacgtggagagcaatcccggccctatggaaaccctgtgccacaggctcaatgtgtgtcaggagaagatcctcgactgctatgagctcgactccgacaagctggtcgaccaaatcaactattggaccctgctgaggtacgaagccgctatgttctatgctgccagggagaggaatctgaggaccattaatcatcaggtcgtccccgctaccaccgtctccaagcagaaggcttgtcaggccatcgaaatgcacatggccctgcagagcctgaataaatccgattacaatatggagccctggacaatgagggagacctgctacgagctgtggtgtgtggcccctaaacagtgctttgccaaaggcggaattaccgtcacagtcatcttcgacggcaacaaggacaatgccatggactatacctcctggaagtttatttacatctatgacaacgataagtgggtgaagaccaacggcaacgtcgattacaccggcatctactataccgtgaactccaaaaaagagtactacgtccagtttaaagacgaggccaaaatctacggagcccagcagtgggaagtgtacatgtatggaacagtcatcacatgtcccgagtatgtgtcctccggaggcaccggcggcagcacagctttcattgtgcatctcaagggcgacaccaattgtctgaagtgcttcagatacaggttcacaaagcacaagggcctctacaaaaacgtgtcctccacctggcattggacaagcaacacaaagaccggcatcgtgaccatcgtctttgacagcgcccaccagagggaaacatttatcaagaccatcaaagtgcctcctagcgtcacactgagcctcggcattatgacactcgcccctgtgaagcagaccctgaacttcgacctgctgaagctggccggcgacgtggagagcaatcccggccctgacccccaagagagacccaggaagctgccccagctctgcaccgagctccaaaccacaatccatgacatcatcctggaatgcgtgtactgcaagcagcaactcctcaggagggaagtgtacgatttcgctaggagggatctgtgtatcgtgtatagggatggcaatccttacgccgtgtgcgataagtgcctgaaattctactccaagattagcgaatacaggcattattgctatagcctctacggaacaaccctggagcagcagtacaacaaacccctctgcgatctgctgatcaggaggatcaactgtcaaaagcctctctgccccgaagagaagcagaggcatctggacaagaaacaaagattccacaacattaggggcaggtggaccggaaggtgcatgagctgctgtagatcctccgcccctgtgaagcagaccctgaacttcgacctgctgaagctggccggcgacgtggagagcaatcccggccctgaccctaccaggagaccctataaactgcccgatctgtgcacagagctcaacacatccctgcaggacattgaaatcacatgtgtctactgcaaaaccgtcctggagctgaccgaagtcttcgaattcgccagaaaggacctcttcgtcgtgtacagggactccatcccccatgctgcctgccataagtgtatcgacttctatagcagaattagagagctcagacattactccgatagcgtgtatggcgacacactggagaagctcacaaacaccggactctacaatctcctgatcaggaggctgagatgccaaaaacccctgaaccccgctgagaaactcaggcacctgaatgagaagaggaggtttcacaatattgccggccattatagaggccagtgccatagctgttgcaacagggctgcccctgtgaagcagaccctgaacttcgacctgctgaagctggccggcgacgtggagagcaatcccggccctgatgctgaagagaagcctaggacactccacgacctctgtcaggccctggaaacaagcgtgcatgagatcgaactgaaatgtgtggagtgtaagaagacactgcagaggtccgaggtctatgacttcgtgagggctgatctgaggattgtctacagggacggcaatccctttgctgtgtgcaaggtgtgcctcaggctgctcagcaagatttccgagtacagacactataactactccctgtatggagacaccctggaacagaccctgaagaagtgcctgaacgaaatcctgatcagaagaatcatttgtcaaaggcctctgtgccctcaggaaaagaaaaggcatgtcgatctgaataaaaggttccataacatttccggcaggtggacaggcagatgcgctgtgtgctggaggcctagggcccctgtgaagcagaccctgaacttcgacctgctgaagctggccggcgacgtggagagcaatcccggccctaatccccaggaaagacctagaagcctccaccacctcagcgaggtgctggaaattcctctcatcgacctgaggctgtcctgcgtctattgcaagaaggagctgaccagggctgaggtctacaatttcgctagaaccgagctgaaactcgtgtatagagacgacttcccctacgctgtgtgtagggtgtgcctgctcttctatagcaaggtgaggaagtacagatactacgattattccgtgtacggcgctacactcgagtccatcaccaagaagcagctgtgtgacctgctgatcaggagatataggtgccagtcccctctgacccccgaggagaagcagctccattgtgacaggaagaggagattccatctgattgcccatggctggaccggaagctgcctcggatgctggaggcagaccgcccctgtgaagcagaccctgaacttcgacctgctgaagctggccggcgacgtggagagcaatcccggccctaactccgaggaaaggccttataagctccaggccctgtgcgatgaggtgaacatctccatccacgacattaacctcgactgcgtcttctgccagagaggcctgtacaggagcgaagtctacgatttcgccagaagcgacctgtgcatcgtgtacaggaaggacaaaccctacggagtctgtcagccctgcctgaagttctacagcaaaatcagggagtacaggaggtacaggcaatccgtgtatggcaccaccctggagaatctgaccaataagcagctgtgcaatatcctgatcaggagaggcaagtgccagaagcctctctgtcctctggagaaacagaagcatgtggacgaaaagaagaggttccatcagatcgccgagcagtggacaggcagatgtacaaggtgttggagacctagctga

SEQ ID NO: 123 - DNA, 3210 bp, artificial
  synthetic polynucleotide
atggccaaagccgccatgctggccaaattcaaggagctctatggagtgagcttcagcgagctggtgagaccctttaagagcaacaaatccacatgctgcgattggtgcatcgccgcctttggcctcacacctagcattgctgacagcatcaagacactgctgcagcagtactgcctgtatctccacatccagtccctggcctgctcctggggaatggtggtgctgctgctcgtgagatacaagtgcggcaaaaacagagagaccatcgagaagctgctctccaagctgctgtgcgtgagccccatgtgcatgatgatcgagcctcccaaactcaggtccacagccgctgccctgtactggtacaagacaggcatctccaacatcagcgaggtctacggcgacacccctgaatggattcagaggcagaccgtgctgcaacacagcttcaacgattgtacctttgagctgagccaaatggtgcaatgggcctacgataacgacattgtggacgattccgagatcgcctacaagtacgctcagctggccgacacaaacagcaacgcttccgcctttctgaagagcaacagccaagccaagatcgtgaaggactgcgccaccatgtgtaggcattataagagggccgagaagaagcagatgagcatgagccagtggatcaagtataggtgcgatagagtggacgacggcggcgactggaaacaaatcgtcatgtttctgaggtatcagggcgtggagttcatgagctttctcacagccctgaagaggttcctgcaaggcatccctaagaagaattgcattctgctgtatggagccgccaacacagacaagtccctgttcggaatgagcctgatgaagttcctgcagggctccgtgatttgtttcgtgaactccaagagccatttctggctccagcctctggccgacgctaagatcggtatgttagatgacgccaccgtgccctgctggaactatatcgacgacaatctcaggaatgccctggatggcaatctggtgagcatggacgtcaaacataggcccctggtgcaactgaagtgcccccccctgctgatcacctccaacattaatgccggcaccgacagcaggtggccttacctgcacaacaggctcgtcgtgttcacatttcctaacgaatttcccttcgatgagaatggcaatcccgtgtacgagctcaacgacaaaaattggaagtccttcttcagcaggacatggagcaggctgagcctggcccctgtgaagcagaccctgaacttcgacctgctgaagctggccggcgacgtggagagcaatcccggccctaagcaaggagccatgctggccgtcttcaaagacacctacggcctgagctttaccgatctggtcaggaatttcaagagcgacaaaaccacctgcaccgactgggtgaccgccattttcggcgtcaatcccacaatcgccgagggctttaagacactgattcagcccttcatcctctacgctcatattcagtgcctggactgcaagtggggcgtgctgattctcgctctgctgagatacaaatgcggcaagagcaggctcacagtggctaagggcctctccaccctgctgcatgtccctgaaacatgtatgttaatccagccccctaagctgagatcctccgtcgctgctctctattggtacagaaccggcatctccaatatcagcgaggtgatgggcgacacacccgagtggattcaaagactgaccatcatccagcacggcatcgacgactccaactttgacctgagcgagatggtccagtgggccttcgataatgaactcacagacgagagcgacatggcctttgagtacgctctgctggccgatagcaatagcaatgccgctgccttcctgaaaagcaattgccaggccaagtacctgaaggactgtgccacaatgtgtaagcattatagaagggcccaaaaaaggcagatgaacatgtcccagtggatcaggtttaggtgtagcaagatcgacgagggcggcgattggagacccatcgtgcagttcctgcgttatcaacaaatcgaattcatcacctttctcggcgccctgaagtccttcctcaaaggaacccctaaaaaaaactgcctcgtgttttgcggccctgctaataccgacaaaagctatttcggcatgtccttcatccacttcatccaaggagccgtcattagcttcgtgaattccaccagccacttttggctggaacccctgaccgatacaaaagtggccatgctggatgatgccaccaccacatgctggacctacttcgatacctacatgaggaacgccctcgacggaaaccctatttccatcgacaggaaacacaagcctctgatccagctgaagtgtccccccattctcctcaccaccaacatccaccccgccaaggacaataggtggccttatctggagagcagaattaccgtgttcgagttccctaacgccttcccctttgacaagaacggcaaccccgtgtatgagattaatgacaagaactggaagtgcttcttcgaaagaacctggagcaggctcgacctggcccctgtgaagcagaccctgaacttcgacctgctgaagctggccggcgacgtggagagcaatcccggccctagagcccactacaacattgtgaccttctgttgcaagtgcgattccacactgaggctgtgtgtccagtccacccacgtggacatcagaaccctcgaggatctcctgatgggaaccctgggcatcgtgtgccccatttgcagccagaagcccacactgcacgagtacatgctcgacctccaacccgagaccacagacctctacggttatcaacaactcgcccctgtgaagcagaccctgaacttcgacctgctgaagctggccggcgacgtggagagcaatcccggccctaggcacaccatgctgtgcatgtgctgcaaatgcgaggccaggatcaagctggtggtcgagtcctccgctgacgacctcagagccttccagcaactcttcctgaacacactgtccttcgtctgcccctggtgtgcttcccagcagaccctgcaggacattgtcctgcatctggagccccagaacgagattcccgtcgatctgctgggccaccaacagctgagcgactccgaagaggagaacgacgaaatcgactga

SEQ ID NO: 124 - DNA, 6969 bp, artificial
  synthetic polynucleotide
atggccaaggctgctatgctggctaaattcaaagagctgtacggcgtctcctttagcgagctcgtgaggcccttcaagagcaataagtccacatgctgtgattggtgcatcgctgcctttggcctgacacctagcatcgccgactccatcaagacactcctgcagcagtactgcctgtacctgcatattcagtccctggcttgttcctggggaatggtcgtcctcctgctggtgagatacaagtgtggaaagaacagggagaccatcgaaaagctgctctccaagctgctgtgtgtgtcccccatgtgtatgatgatcgagccccctaaactgagatccaccgccgccgctctctactggtataagaccggaattagcaacatttccgaggtgtacggagacacccctgagtggattcagaggcagacagtcctccaacacagcttcaatgactgtacattcgaactcagccagatggtgcagtgggcctatgacaacgatattgtggacgatagcgaaatcgcttataagtatgctcagctcgccgataccaattccaatgccagcgccttcctcaagtccaactcccaagctaagatcgtgaaggactgtgccaccatgtgcagacattacaagagggctgaaaaaaagcaaatgtccatgagccagtggatcaagtacagatgcgacagggtggacgacggcggcgactggaaacaaatcgtcatgtttctgaggtaccaaggcgtcgaattcatgagcttcctgacagccctgaagagattcctgcagggcattcccaagaagaactgtatcctcctctatggcgccgccaacaccggaaagtccctgttcggcatgtccctcatgaagttcctgcaaggcagcgtgatctgcttcgtgaactccaagtcccatttttggctccagcccctggccgacgccaagatcggtatgttagatgatgccaccgtgccttgttggaattatatcgatgataacctgaggaacgccctcgacggcaatctggtgagcatggacgtgaaacacaggcccctggtgcaactgaagtgtccccccctgctcattaccagcaacatcaatgccggaaccgacagcaggtggccctatctgcacaacagactggtggtgttcacctttcccaacgagtttcctttcgatgaaaacggcaaccctgtctatgagctgaacgataaaaactggaagtccttcttctccaggacatggagcaggctgagcctcggaggaggaggcggaaagcaaggcgccatgctcgccgtgttcaaggacacctatggactgtccttcaccgacctcgtgagaaattttaaaagcgataagaccacatgtaccgattgggtcaccgccatcttcggcgtcaatcccaccattgctgagggatttaagaccctgatccagcccttcatcctgtacgcccatatccagtgtctggactgcaaatggggcgtcctcattctggctctcctgaggtacaaatgcggaaagtccaggctcaccgtcgccaaaggactgagcaccctgctgcacgtccctgaaacctgtatgttaattcagcctcccaaactcaggtccagcgtggccgccctgtactggtacaggaccggcatctccaacatctccgaggtgatgggagacacacccgaatggattcaaaggctgacaatcatccagcacggcatcgatgactccaactttgatctgtccgaaatggtgcaatgggccttcgacaatgaactgaccgacgaatccgacatggccttcgagtacgctctcctcgccgatagcaacagcaatgccgccgctttcctcaagagcaattgccaggccaaatacctgaaggactgcgccacaatgtgcaaacactataggagggctcaaaagagacagatgaacatgagccaatggattaggtttaggtgttccaagattgatgagggcggcgattggagacctatcgtccagttcctccgttatcaacaaatcgaatttatcacatttctcggcgccctcaagtcctttctcaaaggcacccccaagaagaattgtctcgtgttctgtggccccgccaacacaggcaaatcctatttcggcatgtccttcatccactttatccagggcgccgtcatcagctttgtgaatagcacatcccacttctggctcgagcctctgaccgacaccaaggtcgctatgctggacgacgccaccaccacctgttggacatacttcgacacatacatgagaaacgctctggatggcaaccctatttccattgacaggaaacacaaacctctcatccagctgaagtgtcctcccatcctgctgacaaccaacatccaccccgctaaggataacaggtggccttacctggaaagcaggatcaccgtgttcgagtttcccaatgcctttccttttgacaagaacggcaaccccgtgtacgagattaatgacaaaaattggaaatgcttctttgagagaacatggtccaggctggacctgggaggaggcggaggaacaaaagctaacattctgtacaaattcaaggaggcctatggcatttccttcatggagctggtgaggccctttaagagcgacaaaaccagctgtaccgactggtgtatcacaggctacggaattagccctagcgtggccgaatccctgaaagtcctgatcaaacagcactccctgtatacccacctccagtgcctcacctgcgatagaggcatcatcatcctgctgctcatcaggttcaggtgctccaagaataggctgaccgtggctaagctcatgagcaatctcctgtccatccccgagacctgcatggtcatcgaaccccccaagctcaggagccagacctgtgccctctactggttcagaaccgccatgagcaatatctccgacgtgcagggaacaacacccgagtggattgataggctgaccgtcctccagcacagctttaacgacaatattttcgatctgagcgagatggtccaatgggcctacgacaatgagctcaccgatgactccgacatcgcctactattatgcccaactcgctgatagcaactccaacgccgccgcctttctcaagagcaacagccaggctaaaatcgtcaaagattgtggaatcatgtgcaggcactacaaaaaggccgaaaagaggaagatgagcattggacagtggattcaatccaggtgtgagaagacaaacgacggaggaaactggaggcccatcgtccaactgctcaggtatcagaatattgagtttaccgccttcctgggagccttcaagaaatttctgaagggcatccctaagaagagctgtatgctgatttgcggccccgctaacaccggcaagtcctacttcggcatgtccctgatccaattcctgaagggctgtgtcatcagctgcgtcaacagcaaatcccatttctggctccaacctctcagcgatgccaaaattggcatgatcgacgatgtcacccctatcagctggacctacatcgatgactacatgaggaatgccctcgatggaaacgaaattagcatcgatgtgaagcacagggccctcgtgcaactcaagtgccctcccctgctgctcacaagcaataccaatgctggcaccgattccagatggccctacctgcacagcaggctgaccgtgtttgaattcaagaaccccttccccttcgacgaaaatggaaaccccgtgtatgccatcaacgatgagaactggaagagcttcttcagcagaacatggtgtaagctggatctgggcggaggcggcggaagagcccactataacatcgtgacattttgctgcaaatgcgacagcaccctgaggctctgcgtgcagtccacacacgtcgatattaggaccctggaagacctcctcatgggaaccctgggcatcgtgtgccccatttgcagccagaagcccaccctgcacgaatatatgctcgacctgcagcctgaaaccaccgatctgtacggctaccaacagctgggaggaggcggcggcagacacaccatgctctgtatgtgttgcaaatgcgaagctaggatcaagctggtggtggaatcctccgccgatgatctgagagctttccagcaactcttcctcaacacactcagcttcgtgtgtccttggtgcgccagccaacagacactgcaagacattgtgctgcatctggaaccccagaacgagatccctgtggacctcctgggacaccagcaactgtccgactccgaggaagagaacgacgaaattgatggcggaggcggaggaatgaagatgcagacccccaaggaatccctgtccgaaaggctgtccgccctgcaggacaagatcctggaccactatgagaatgacagcaaggatattaacagccagatcagctactggcaactcattaggctcgagaatgccattctctttaccgccagggagcacggcatcaccaagctgaatcaccaagtggtcccccccatcaacattagcaaatccaaggcccacaaagccattgagctccaaatggccctcaagggcctcgcccaaagcaaatacaacaacgaggagtggaccctgcaagacacatgcgaagagctgtggaacacagaacccagccagtgctttaaaaagggcggcaaaaccgtgcatgtgtactttgacggcaataaagacaattgcatgaattacgtggtgtgggattccatctactacatcaccgaaacaggcatctgggataagaccgccgcttgtgtgagctactggggcgtctattatatcaaggacggagacacaacatattacgtgcagttcaagagcgaatgcgagaagtatggcaactccaacacatgggaggtgcagtacggaggaaacgtgatcgattgcaacgatagcatgtgcagcggaggaacaggcggttctaccacacctatcatccacctgaaaggcgataagaacagcctgaagtgtctcaggtacagactcaggaaatacgccgatcactatagcgagatctcctccacctggcattggacaggatgcaataaaaacaccggcatcctcacagtgacctacaactccgaagtccaaaggaacacattcctggacgtcgtcacaatccctaacagcgtgcagatctccgtcggatacatgacaatcggaggaggcggcggcatggagagcattcccgctaggctcaatgctgtgcaggaaaaaattctggacctctacgaggccgattccaacgacctgaacgctcagatcgaacactggaagctgacaaggatggagtgtgtcctcttttacaaagccaaggaactgggaatcacacatatcggacaccaggtggtgccccccatggccgtctccaaggctaaagcttgccaggctatcgaactgcagctcgccctcgaggccctgaacaagacccaatacagcacagacggctggacactccaacagacatccctcgagatgtggagagccgaacctcagaaatactttaagaagcacggctataccatcaccgtgcagtatgataacgataagaataacaccatggactacaccaattggaaagaaatttatctgctgggcgagtgtgaatgcacaatcgtggagggccaagtggactattacggcctgtactactggtgtgacggcgagaagatctattttgtgaaattttccaatgacgccaaacaatactgcgtcaccggagtgtgggaagtgcacgtgggaggccaggtcattgtctgccctgctagcgtgtcctccggaggcacaggcggctccaccgcccctattatccatctgaagggcgatcctaattccctcaagtgtctgagatacagggtgaaaacccataagtccctgtacgtccagatctccagcacatggcattggacctccaatgaatgcaccaacaacaaactgggcatcgtgaccatcacctactccgatgagacacaaagacagcaatttctcaagaccgtcaagatccctaatacagtgcaggtgattcagggcgtgatgtccctgggaggcggcggcggcatggaagagatctccgccaggctgagcgctgtgcaagataagattctggacatttatgaggctgataaaaacgacctcacatcccagatcgagcattggaaactgatcaggatggagtgcgccatcatgtacaccgctaggcaaatgggaatttcccacctgtgccatcaagtggtcccttccctcgtggctagcaaaacaaaagccttccaggtgattgaactccagatggccctggaaaccctcaatgccagcccctacaaaacagatgagtggaccctccagcagacctccctggaagtgtggctcagcgagcctcaaaagtgcttcaaaaaaaagggcatcacagtgaccgtccagtacgataatgataaggccaacaccatggattataccaattggtccgagatctatatcattgaggagacaacctgcaccctggtggctggcgaagtcgactacgtgggactgtattacatccacggcaatgagaaaacctacttcaaatattttaaggaggatgctaagaagtactccaagacccagctgtgggaggtccacgtcggaagcagagtcattgtgtgccctaccagcattcccagcggaggcacaggaggctccgtgagccccattgtccacctcaaaggcgaccccaactccctcaaatgcctcaggtataggctcaaacctttcaaggacctgtattgtaatatgtccagcacatggcactggacctccgacgacaagggcgacaaagtgggaatcgtgaccgtcacctatacaaccgagacacagaggcagctcttcctcaataccgtgaaaatcccccccacagtgcagatcagcaccggcgtgatgagcctgtga

SEQ ID NO: 125 - DNA, 7368 bp, artificial
  synthetic polynucleotide
atggccaaggctgctatgctggctaaattcaaagaactgtatggagtctccttcagcgagctggtgagacccttcaagagcaataaatccacatgttgtgactggtgtattgccgccttcggactgaccccctccatcgccgactccatcaagaccctgctccagcagtattgtctgtatctgcacatccagtccctggcttgcagctggggcatggtggtcctgctcctcgtcaggtataagtgcggcaagaacagagagaccatcgaaaagctcctcagcaaactcctgtgtgtcagccccatgtgcatgatgatcgaaccccctaagctcagaagcaccgctgccgccctctattggtataagacaggcatcagcaacatcagcgaggtgtatggcgatacccctgagtggattcagaggcagacagtgctccagcacagctttaatgactgcacattcgaactgtcccagatggtgcaatgggcctacgacaacgacattgtcgacgactccgagatcgcttataagtacgcccagctggctgacacaaattccaacgccagcgcttttctgaagagcaatagccaggctaagattgtcaaggactgcgctacaatgtgcaggcactataaaagagccgagaaaaaacaaatgagcatgagccagtggatcaaatatagatgcgatagggtggacgatggcggcgactggaaacaaatcgtcatgttcctccgttatcaaggcgtcgaattcatgagcttcctgacagctctgaaaaggttcctgcagggcatccccaaaaagaactgcatcctgctgtacggcgccgccaatacaggcaaaagcctgtttggcatgagcctgatgaaatttctgcagggcagcgtgatctgtttcgtcaatagcaaaagccacttttggctgcaacccctggctgatgctaaaatcggtatgttagacgacgccaccgtgccttgctggaattacattgacgataacctcaggaatgccctggatggaaatctggtgagcatggatgtgaagcacaggcccctggtccagctgaagtgtccccccctgctgatcacctccaatatcaatgctggaaccgacagcaggtggccttacctccataacaggctggtggtgtttacattccccaatgagttcccctttgacgagaacggcaatcccgtgtacgagctgaacgataaaaactggaaaagcttcttttccaggacctggtccagactgtccctcgcccctgtgaagcagaccctgaacttcgacctgctgaagctggccggcgacgtggagagcaatcccggccctaagcagggcgctatgctcgctgtgtttaaagacacatatggactctccttcaccgacctggtgaggaatttcaaaagcgacaaaaccacatgtacagactgggtcaccgccattttcggcgtgaatcccaccatcgccgagggatttaaaacactcatccagcccttcatcctgtacgcccacatccagtgcctggactgtaagtggggagtgctgatcctcgctctcctcagatacaagtgcggaaaaagcaggctgaccgtcgccaagggactcagcacactgctccatgtgcccgagacctgtatgctcatccaaccccctaaactcagaagctccgtcgctgctctgtactggtacagaaccggcatctccaacattagcgaggtgatgggcgacacccccgaatggattcaaagactgacaatcattcagcacggcatcgacgatagcaacttcgacctgtccgaaatggtccaatgggcctttgacaatgagctgaccgatgagtccgatatggcctttgagtatgctctgctggccgacagcaattccaacgctgccgctttcctgaaaagcaactgccaggccaagtatctcaaagactgcgccaccatgtgcaagcactacaggagagcccagaaaaggcagatgaacatgagccaatggattaggttcaggtgttccaaaatcgacgaaggcggcgattggagacccattgtccaattcctgagataccaacagatcgaatttatcacctttctcggagccctcaaaagctttctcaagggcacacccaagaaaaactgtctggtcttctgcggacctgctaatacaggaaagtcctactttggaatgtcctttattcattttatccagggcgctgtcattagctttgtcaatagcacctcccatttctggctcgaacctctgaccgacaccaaggtcgctatgctcgatgatgctaccaccacctgctggacatacttcgatacctatatgaggaacgctctggatggcaaccccattagcatcgacagaaagcacaagcccctcatccagctcaagtgcccccccatcctgctcacaacaaatatccatcccgctaaagacaataggtggccctatctggaaagcagaattaccgtgttcgaattccctaatgccttccccttcgataagaatggaaatcctgtgtatgagatcaatgacaagaattggaaatgttttttcgagagaacctggagcaggctcgacctggcccctgtgaagcagaccctgaacttcgacctgctgaagctggccggcgacgtggagagcaatcccggccctaccaaggccaatattctgtataagtttaaagaagcctacggcatcagctttatggagctggtgaggcctttcaagagcgataagacctcctgtaccgactggtgcatcaccggatacggaatttcccctagcgtggccgagagcctcaaagtgctgatcaagcagcactccctgtacacacacctgcagtgtctgacatgcgataggggcatcatcatcctgctcctgatcaggtttaggtgcagcaaaaacaggctgaccgtggccaagctgatgtccaacctcctgtccatccccgagacatgcatggtgattgagcctcctaagctgagatcccagacatgtgctctgtattggttcaggacagccatgagcaacatctccgacgtgcagggaaccacacctgaatggattgacagactgaccgtgctgcagcactccttcaatgataacatctttgacctcagcgaaatggtgcagtgggcttacgataacgagctgacagacgactccgacatcgcctattactatgcccagctggccgactccaatagcaatgctgctgctttcctgaagtccaacagccaagctaaaatcgtcaaagactgtggcatcatgtgtaggcattataagaaagccgagaaaaggaaaatgagcattggccaatggattcagagcagatgtgagaagaccaacgatggaggcaactggagacccatcgtgcagctcctcaggtaccaaaacatcgagttcacagccttcctcggagccttcaagaagttcctcaaaggcattcccaagaagagctgtatgttaatctgcggccccgctaacacaggcaagagctacttcggcatgagcctcatccaatttctcaaaggatgtgtcatcagctgcgtgaacagcaagagccatttttggctgcagcctctgagcgacgccaaaattggcatgatcgacgacgtcacccctatttcctggacctacattgatgactacatgagaaacgccctggacggaaatgagatttccattgatgtcaagcacagagctctggtccaactcaaatgtcctcccctcctcctgacaagcaatacaaatgccggcacagattccagatggccttatctccacagcaggctcaccgtcttcgagttcaaaaacccctttcccttcgacgaaaatggcaaccccgtctatgctatcaacgacgagaactggaaatcctttttctccaggacctggtgcaagctggatctcgcccctgtgaagcagaccctgaacttcgacctgctgaagctggccggcgacgtggagagcaatcccggccctagggctcactacaacattgtgacattctgttgtaagtgtgacagcacactgaggctgtgcgtgcagtccacccacgtggatattaggaccctggaggacctcctcatgggaaccctcggaattgtgtgccctatttgctcccaaaagcctaccctgcacgagtacatgctggacctgcagcccgagaccaccgacctgtatggataccagcaactggcccctgtgaagcagaccctgaacttcgacctgctgaagctggccggcgacgtggagagcaatcccggccctaggcataccatgctgtgtatgtgttgcaagtgcgaggctaggattaagctcgtggtggagagctccgctgacgatctgagggctttccaacaactgttcctcaataccctgtcctttgtctgtccctggtgtgccagccaacagaccctgcaggacatcgtcctccacctggagccccagaatgaaattcccgtggacctgctcggccaccagcagctgtccgactccgaggaagagaacgatgaaatcgacgcccctgtgaagcagaccctgaacttcgacctgctgaagctggccggcgacgtggagagcaatcccggccctatgaagatgcagacccctaaagagtccctctccgagaggctcagcgccctgcaggataaaatcctcgatcactacgaaaacgactccaaggacattaacagccagattagctactggcaactgatcaggctcgagaatgccatcctgttcacagccagggaacacggaattacaaagctgaatcaccaggtcgtgcctcccatcaatatctccaagagcaaagctcataaagccatcgagctccagatggccctgaagggcctggcccagagcaaatacaacaacgaggaatggacactgcaagacacctgtgaggagctgtggaatacagagccttcccaatgcttcaaaaaaggaggcaaaacagtgcatgtctatttcgacggcaataaggacaactgcatgaactacgtggtctgggactccatctactacatcaccgaaaccggaatctgggataaaacagccgcttgcgtgagctactggggcgtgtactacatcaaggacggagatacaacatattacgtccagttcaaatccgagtgcgagaaatacggaaacagcaatacctgggaagtgcaatatggcggcaacgtcatcgattgcaatgactccatgtgcagcggaggcacaggcggctccaccacccccatcatccacctgaaaggagacaaaaattccctgaagtgcctgaggtataggctgaggaagtacgccgatcactatagcgaaatctccagcacctggcactggacaggatgtaataagaacaccggcattctcaccgtcacctacaacagcgaagtgcagaggaacacattcctcgacgtggtcaccattcctaactccgtccaaatttccgtcggctatatgacaattgcccctgtgaagcagaccctgaacttcgacctgctgaagctggccggcgacgtggagagcaatcccggccctatggaaagcattcccgctaggctcaacgctgtgcaggagaagattctggacctgtatgaggccgatagcaacgacctcaatgctcaaatcgaacattggaaactgaccaggatggagtgcgtcctgttttacaaggccaaagagctgggcatcacacacatcggccatcaagtggtgcctcccatggctgtgagcaaggccaaagcttgccaggccatcgaactccagctggccctggaagccctcaataagacccagtacagcacagacggatggaccctgcaacagaccagcctggagatgtggagggctgagcctcaaaagtacttcaagaagcacggctacaccatcacagtccaatatgataatgataagaataataccatggattacacaaattggaaagaaatctacctgctgggagagtgcgaatgcaccatcgtcgagggacaagtggattactacggactctattactggtgcgacggcgagaagatttatttcgtgaagttttccaacgacgctaagcagtattgtgtcaccggcgtgtgggaggtccacgtcggaggccaggtgatcgtctgtcctgctagcgtctcctccggaggaacaggaggttctacagcccccatcatccatctgaaaggcgaccctaactccctgaaatgcctcagatacagggtcaagacccacaagtccctgtacgtccagatctccagcacctggcattggaccagcaacgaatgcaccaacaacaagctcggcatcgtcacaatcacctacagcgacgagacccaaaggcagcaatttctcaagacagtgaaaatccctaatacagtccaggtcatccagggcgtcatgtccctggcccctgtgaagcagaccctgaacttcgacctgctgaagctggccggcgacgtggagagcaatcccggccctatggaggagatttccgccagactgagcgccgtgcaagacaaaatcctggacatctatgaagctgataagaatgatctgaccagccaaatcgaacactggaagctgattagaatggagtgcgccatcatgtacaccgccagacaaatgggcatttcccacctgtgtcaccaggtggtgccttccctggtcgccagcaagaccaaagccttccaggtgatcgagctgcagatggccctcgaaaccctcaatgcttccccttacaagaccgatgagtggaccctgcagcaaaccagcctcgaagtctggctgagcgaaccccaaaaatgttttaagaagaagggcattaccgtgaccgtgcaatacgacaatgacaaggccaatacaatggattacaccaactggagcgaaatttacatcatcgaggagaccacatgcaccctggtcgccggcgaagtcgattacgtgggcctgtactacatccatggcaatgaaaagacatacttcaagtattttaaggaagacgccaagaagtatagcaagacccagctgtgggaagtgcacgtcggaagcagggtcatcgtgtgccccaccagcattccttccggcggaacaggaggctccgtgtcccccatcgtgcacctgaagggagatcctaacagcctcaagtgcctcaggtacaggctgaagcccttcaaagatctgtactgcaacatgagcagcacctggcactggaccagcgacgacaaaggcgacaaagtcggcatcgtgaccgtgacctataccacagaaacccagaggcaactgtttctgaacaccgtgaaaatcccccctaccgtgcaaatctccacaggagtcatgagcctctga

SEQ ID NO: 126 - DNA, 6561 bp, artificial
  synthetic polynucleotide
atggagaccctctgtcaaaggctgaacgtctgccaggataaaattctgacccactatgaaaacgactccaccgatctgagggaccacattgattattggaaacacatgaggctggagtgtgccatctactacaaggccagggagatgggcttcaagcacatcaaccatcaggtggtgcctaccctggccgtgagcaagaacaaagccctccaagccatcgagctccaactgacactcgaaacaatttataattcccagtactccaatgaaaaatggacactgcaagacgtcagcctcgaagtgtacctcacagcccccaccggctgcattaagaagcatggctacaccgtggaagtgcaattcgatggcgacatctgtaataccatgcactacaccaattggacccatatctatatctgcgaggaagcttccgtgaccgtggtcgaaggacaagtggactattatggcctctactatgtgcacgaaggcatcaggacatacttcgtccagttcaaggatgatgccgagaaatacagcaaaaataaggtctgggaagttcatgctggcggacaagtgatcctgtgccccacaagcgtgttctccggaggcacaggaggttctaccacccctattgtccacctcaagggcgatgccaacacactcaaatgcctgaggtataggttcaaaaaacactgtacactgtacaccgctgtcagcagcacctggcactggacaggacacaacgtcaaacacaaaagcgccatcgtgacactgacatacgatagcgagtggcaaagggatcagtttctgagccaggtgaaaatccccaagacaattaccgtgagcacaggattcatgtccatcggaggaggcggaggtatgcaaacccccaaagagaccctctccgagaggctctcctgtgtgcaggacaaaattatcgaccactatgagaatgacagcaaagacatcgattcccagatccagtactggcaactgatcaggtgggagaacgccattttctttgctgccagggagcacggaatccagaccctgaatcaccaggtggtgcccgcctataacatttccaagagcaaggcccacaaggctattgagctgcagatggctctgcagggactggcccaatccgcttataagaccgaagactggaccctgcaagatacctgcgaagagctctggaacaccgagcctacacactgtttcaagaagggcggccaaaccgtccaggtctattttgatggcaataaagataattgcatgacctacgtcgcctgggacagcgtgtactacatgaccgatgccggcacatgggacaaaaccgccacatgcgtgagccataggggcctgtactatgtgaaggaaggctacaacacattctacattgaattcaagagcgaatgcgagaagtatggcaacaccggcacctgggaggtgcatttcggcaataacgtcatcgattgtaacgatagcatgtgctccggcggcacaggcggctccaccacacctatcatccatctcaaaggcgacaggaacagcctcaagtgcctcagatatagactgaggaagcacagcgatcactacagggacattagctccacctggcattggacaggagccggaaacgaaaagacaggcatcctgaccgtcacataccatagcgagacccagaggaccaagttcctcaacaccgtcgccatccctgatagcgtgcaaatcctggtgggatacatgaccatgggcggcggcggcggaatggaaacactcagccagagactcaacgtgtgtcaggataaaatcctcgagcattacgaaaacgacagcaaaaggctgtgcgaccacatcgactactggaagcacatcagactggagtgcgtgctgatgtataaagccagggaaatgggcattcacagcatcaatcaccaagtcgtccccgccctgtccgtgagcaaagccaaagctctccaggccattgaactgcaaatgatgctggagaccctgaataatacagagtacaaaaacgaggattggaccatgcaacagaccagcctggagctgtatctgacagcccctaccggctgtctgaagaaacacggatacaccgtcgaggtgcaatttgatggcgacgtccataatacaatgcattataccaactggaaattcatctatctctgcatcgacggccagtgcaccgtcgtcgagggccaggtcaattgcaagggcatttactacgtccatgagggacacattacatattttgtcaattttaccgaggaggccaaaaagtacggaaccggaaagaaatgggaggtccatgccggcggccaagtcatcgtcttccctgaaagcgtgtttagcggcggaacaggcggctccaccacccccatcatccatctgaagggcgacgccaatatcctgaagtgtctgaggtacaggctctccaagtataagcaactgtacgagcaggtgagctccacatggcattggacctgcacagacggcaagcacaagaatgccatcgtgaccctgacctacatcagcacatcccagagggacgacttcctgaacacagtgaagatccccaacaccgtctccgtctccaccggctatatgacaattggcggaggcggcggcatggaagagatctccgccagactgaatgctgtgcaagagaagatcctggatctgtacgaggctgacaaaacagacctgcctagccagattgagcattggaaactgatcaggatggagtgcgccctcctgtataccgccaaacagatgggcttctcccacctgtgccatcaggtcgtgccctccctcctggcttccaagaccaaggcttttcaggtgatcgagctccagatggccctggagacactcagcaagtcccaatacagcacatcccagtggacactccagcaaaccagcctcgaggtctggctgtgtgaacctcccaagtgcttcaagaagcaaggagaaacagtcaccgtgcagtatgataacgacaaaaagaacacaatggattacacaaactggggcgagatctacattatcgaggaggatacctgcaccatggtgaccggcaaggtcgattatattggcatgtactacatccacaactgtgagaaagtctactttaaatatttcaaggaggacgctgccaaatatagcaagacccagatgtgggaggtgcacgtgggcggacaggtcatcgtctgtcccaccagcattagcagcggcggaacaggcggcagcgtggcccccattgtccatctcaagggagaaagcaactccctgaaatgcctgagatacagactgaaaccctacaaggaactgtacagctccatgtcctccacatggcactggacctccgacaacaagaattccaagaacggcattgtgaccgtgaccttcgtcaccgagcagcaacagcaaatgtttctcggaacagtcaagatccctcctaccgtgcagattagcaccggattcatgaccctgggcggaggaggcggcgaccctcaagagagacctagaaagctgccccagctctgcacagaactgcagaccaccattcatgacattattctggaatgcgtctactgtaagcagcagctcctcagaagggaagtgtacgacttcgccttcagggacctgtgtattgtctatagagacggaaacccctacgccgtctgcgacaaatgtctcaagttctacagcaaaatcagcgagtacaggcactattgttattccctctacggcaccacactggaacagcagtacaacaagcccctctgtgacctcctgatcagatgcattaactgccagaagcctctgtgccccgaggaaaaacaaagacacctggacaagaaacagagattccataacatcaggggcagatggacaggaaggtgtatgtcctgctgcaggtcctccggcggaggaggcggagaccctaccagaagaccttacaagctgcctgatctgtgtaccgagctcaacaccagcctccaggacattgagattacctgcgtgtactgcaagaccgtcctggagctgacagaggtctttgaatttgctttcaaggatctgttcgtcgtgtacagggacagcatccctcatgccgcctgtcacaaatgtatcgacttttatagcaggattagagaactgagacattattccgattccgtgtatggagacaccctcgaaaaactcacaaacaccggcctctacaacctgctgatcaggtgcctgaggtgtcagaaacccctgaaccccgccgaaaagctgaggcatctcaacgagaagaggaggttccacaacattgccggccactacaggggacagtgccactcctgctgtaacagagccggaggaggcggcggcaatcccgctgaaagacccaggaagctccacgaactgtcctccgctctggagatcccctatgatgagctgaggctgaattgcgtctactgcaagggacaactgacagagaccgaggtgctggattttgcctttaccgacctcacaatcgtgtacagggatgatacacctcatggagtgtgcaccaagtgtctgagattctattccaaggtgtccgagttcaggtggtacaggtatagcgtctatggcaccaccctggagaagctcacaaataaaggaatttgcgacctcctgattagatgcatcacatgccagaggcccctctgtcctgaggaaaagcagagacatctggataaaaaaaaaagattccacaatatcggaggaagatggaccggcaggtgtattgcctgttggagaaggcctggaggcggcggcggcgataccgaggagaagcccagaacactccatgatctctgccaggctctcgaaaccacaattcacaatattgaactgcagtgcgtcgaatgcaagaaacctctccagaggagcgaagtgtacgatttcgcttttgccgacctgacagtggtctacagagagggaaacccctttggcatttgcaagctgtgcctcagattcctctccaagattagcgaatacaggcattacaactacagcgtctacggcaacacactggagcagaccgtgaagaagcccctcaacgaaattctcattaggtgtattatctgccagagacccctctgcccccaggagaagaagaggcatgtggacctgaacaagagatttcacaatattagcggaagatgggccggaaggtgtgctgcttgttggagaagcagaggaggaggcggcggcgaccccaagcaaaggccctacaagctgcccgatctgtgcaccgaactcaacacctccctgcaggacgtcagcatcgcttgtgtgtactgtaaggccaccctcgaaaggaccgaggtgtaccaatttgcctttaaagacctctgcattgtctacagggactgcatcgcctacgccgcctgccacaaatgcatcgatttttattccagaattagagagctgaggtactacagcaatagcgtgtacggcgaaaccctcgagaagattaccaacaccgagctgtataacctgctcattaggtgcctcaggtgccaaaagcccctgaatcctgctgaaaaaaggaggcatctgaaggacaagagaagatttcactccattgctggacagtacaggggccagtgcaacacatgctgtgatcaggctggcggcggcggcggagatcccgccacaaggcccagaaccctccatgagctgtgcgaagtcctcgaggaaagcgtccacgaaatcaggctgcaatgcgtgcaatgcaagaaggagctgcaaaggagagaggtctacaaattcctgttcaccgacctgagaatcgtgtatagggataacaacccctacggcgtgtgtatcatgtgcctcaggttcctcagcaagatctccgaatatagacattatcagtactccctgtatggcaaaacactggaggagagggtgaaaaaacccctcagcgagatcacaatcaggtgcatcatctgccaaacacccctgtgtcctgaagaaaaggaaagacatgtcaatgccaacaaaagatttcataacattatgggaaggtggacaggcaggtgcagcgaatgctggaggcccaggggaggcggcggaggagatgccgaagagaagcctaggacactgcatgacctgtgccaagccctggagacctccgtgcacgaaatcgagctgaagtgtgtcgagtgtaagaaaaccctgcagagatccgaggtctacgactttgtgttcgccgacctcaggatcgtctacagagacggaaatccctttgccgtgtgcaaagtctgcctgagactcctctccaaaatttccgagtatagacactacaattatagcctgtatggcgataccctggagcaaaccctgaaaaagtgtctcaacgaaatcctcattagatgcattatctgtcaaagacccctctgtccccaagagaagaagagacatgtggacctcaacaagaggtttcacaacatcagcggcaggtggaccggcaggtgtgccgtgtgttggaggcctagatga

SEQ ID NO: 127 - DNA, 7131 bp, artificial
  synthetic polynucleotide
atggagaccctgtgccagaggctgaacgtgtgccaggataaaatcctgacccactacgagaacgacagcacagacctgagagaccacatcgactactggaagcacatgagactggaatgcgccatctactacaaggccagggagatgggcttcaagcacattaaccaccaggtggtgcccaccctcgccgtgtccaagaacaaggccctgcaggctatcgagctgcagctgaccctggagaccatctacaactcccagtactccaacgagaagtggaccctgcaggacgtgagcctcgaggtgtacctgaccgctcccaccggatgcatcaagaagcacggctataccgtggaggtgcagtttgatggcgacatctgcaacaccatgcactacaccaattggacacacatctacatctgcgaggaggcttccgtgaccgtggtcgaaggccaggtcgactattacggcctgtactacgtgcacgagggaatcaggacctactttgtgcagttcaaggacgacgccgagaagtacagcaagaacaaggtgtgggaggttcatgctggaggccaggtgattctgtgccccaccagcgtcttttccggcggcacaggcggcagcacaacccccatcgtgcatctgaaaggcgatgccaacaccctgaaatgcctgaggtataggttcaagaagcactgcaccctgtacaccgccgtgagctccacctggcattggacaggacacaacgtgaagcacaagagcgccatcgtgacactgacctacgacagcgagtggcagagagaccagttcctgagccaggtgaaaatccccaagaccatcaccgtgtccaccggctttatgtccatcgcccctgtgaagcagaccctgaacttcgacctgctgaagctggccggcgacgtggagagcaatcccggccctatgcagacacccaaggaaaccctgtccgaaaggctgtcctgcgtccaggacaagatcattgatcactatgagaacgactccaaagacatcgacagccagatccagtactggcagctcatcagatgggagaacgccatcttcttcgctgccagggagcacggcatccagaccctgaaccaccaggtggtgcccgcctacaacatcagcaagtccaaggctcacaaagccatcgagctgcagatggctctgcagggcctggctcagagcgcctacaaaaccgaggactggacactgcaggacacctgcgaggagctgtggaacacagagcccacccactgcttcaaaaagggaggccagacagtgcaggtgtacttcgacggcaacaaggacaactgcatgacctacgtggcctgggacagcgtgtactacatgacagacgccggcacctgggacaagacagccacctgcgtgtcccacaggggcctgtactacgtgaaggagggctacaacacattctacatcgagtttaagtccgagtgcgagaagtacggcaacaccggcacctgggaggtgcacttcggcaacaacgtgatcgactgcaatgacagcatgtgttccggcggcaccggaggctccacaacacccattatccatctgaagggcgacaggaacagcctcaagtgcctgaggtacagactgagaaagcacagcgaccactacagagacatctcctccacctggcactggaccggcgctggaaacgagaagaccggcatcctgacagtgacataccacagcgagacccagaggaccaagttcctgaacaccgtggccatccccgacagcgtgcagatcctggtgggctacatgacaatggcccctgtgaagcagaccctgaacttcgacctgctgaagctggccggcgacgtggagagcaatcccggccctatggagaccctgtcccagaggctgaacgtgtgccaggacaagatcctggagcactacgagaacgactccaaaaggctgtgcgaccacatcgactactggaagcatattaggctggagtgcgtgctgatgtacaaggccagggagatgggcatccactccatcaatcaccaggtggtgcccgctctgtccgtgagcaaggccaaagccctccaggccattgaactccagatgatgctggagaccctgaacaacaccgagtacaagaacgaggattggaccatgcagcagacctccctcgagctgtacctgacagcccccaccggctgcctgaagaagcacggctacaccgtggaggtgcagttcgacggcgacgtgcacaataccatgcactacaccaactggaagttcatctacctctgcatcgacggccagtgtacagtggtggaaggccaggtcaactgcaagggaatttactacgtgcacgagggccacatcacctacttcgtgaactttaccgaggaggccaagaagtacggaaccggcaagaagtgggaggttcatgctggcggccaggtgatcgtgttccccgagtccgtgttcagcggaggcacaggcggctccaccacacctatcatccacctgaagggcgacgctaacatcctgaagtgcctgaggtacaggctgagcaagtacaagcagctgtacgaacaggtgtccagcacctggcactggacctgcaccgacggcaaacacaagaacgccatcgtcacactgacctacatttccaccagccaaagggatgacttcctgaacaccgtgaagatccctaataccgtcagcgtgagcaccggctatatgaccatcgcccctgtgaagcagaccctgaacttcgacctgctgaagctggccggcgacgtggagagcaatcccggccctatggaggagatctccgccaggctgaatgccgtgcaggagaagatcctggacctgtacgaggccgacaaaacagacctgcctagccagatcgagcactggaagctcatcaggatggagtgcgccctgctctacaccgccaagcagatgggcttttcccacctgtgtcaccaggtggtgcccagcctgctggccagcaagaccaaggccttccaggtgatcgagctgcagatggccctcgagaccctgagcaagtcccagtacagcacctcccagtggacactgcaacagacctccctggaggtgtggctgtgcgagcctcccaagtgcttcaagaagcagggcgaaaccgtgaccgtgcagtacgacaacgacaagaagaacaccatggactacaccaactggggagagatttacatcatcgaggaggacacctgcacaatggtgaccggcaaggtggattacatcggcatgtactacatccacaactgcgaaaaggtgtacttcaagtacttcaaggaggacgccgccaagtactccaaaacccagatgtgggaggtccacgtgggcggccaggtgatcgtgtgccctacctccattagcagcggaggcacaggaggcagcgtcgctcccatcgtgcacctcaagggcgagagcaactccctgaagtgcctgagatacaggctgaagccctacaaggaactgtacagcagcatgtcctccacatggcactggaccagcgacaacaaaaactccaagaacggcatcgtgacagtgaccttcgtgaccgagcagcagcagcagatgttcctcggcaccgtgaagatcccccccaccgtgcagatctccaccggctttatgaccctggcccctgtgaagcagaccctgaacttcgacctgctgaagctggccggcgacgtggagagcaatcccggccctgacccccaggagaggcctaggaagctgccccagctgtgcaccgagctgcagaccaccatccacgacatcatcctggagtgcgtgtactgcaagcaacagctgctgaggagggaggtgtacgacttcgccttcagggacctgtgcatcgtgtacagagacggcaacccctacgccgtgtgcgacaagtgcctgaagttctacagcaagatcagcgagtacaggcactactgctactccctgtacggcaccaccctggagcagcagtacaacaagcccctgtgcgacctgctgatcaggtgtatcaactgccagaagcctctgtgccccgaggagaagcagaggcacctggacaagaagcagaggttccacaacatcaggggcaggtggaccggcaggtgcatgtcctgctgcaggagcagcgcccctgtgaagcagaccctgaacttcgacctgctgaagctggccggcgacgtggagagcaatcccggccctgaccccaccaggaggccctacaagctgcccgacctgtgtaccgagctgaacaccagcctgcaggacatcgagatcacctgcgtgtactgcaagaccgtgctggagctcaccgaggtgttcgagttcgccttcaaggatctgttcgtggtgtacagggacagcattccccacgccgcctgccacaagtgcatcgacttctacagcaggatcagggagctgaggcactactccgatagcgtgtacggcgacaccctggaaaagctgaccaacaccggcctgtacaacctgctgatcaggtgcctgagatgccagaagcccctgaaccccgccgagaagctgagacacctgaacgagaagaggaggttccacaacatcgccggccactacaggggccaatgccacagctgctgcaacagagccgcccctgtgaagcagaccctgaacttcgacctgctgaagctggccggcgacgtggagagcaatcccggccctaatcccgccgagagacccaggaagctgcacgagctgtccagcgccctcgagatcccctacgacgagctgaggctgaactgcgtctactgcaagggccagctgaccgagaccgaggtgctggacttcgccttcaccgacctgaccatcgtgtacagggacgacaccccccacggcgtgtgcaccaagtgcctgaggttctacagcaaggtgagcgagttcaggtggtacaggtacagcgtgtacggcaccaccctggagaagctgaccaacaagggcatctgcgacctgctgatcaggtgcatcacctgtcagaggcccctgtgccccgaggagaagcagaggcacctggacaagaagaagaggttccacaacatcggcggcagatggaccggcagatgcatcgcctgctggaggaggcccgcccctgtgaagcagaccctgaacttcgacctgctgaagctggccggcgacgtggagagcaatcccggccctgacaccgaggaaaagcccaggaccctgcacgacctgtgccaggccctggagaccacaatccacaacatcgagctgcagtgcgtggagtgcaaaaagcccctgcagaggtccgaggtgtacgacttcgccttcgccgatctgaccgtggtgtacagggagggcaaccccttcggcatctgcaagctgtgcctgaggttcctgagcaagatctccgagtacaggcactacaactacagcgtgtacggcaacaccctggagcagaccgtgaagaagcccctgaacgagatcctgatcaggtgcatcatctgccagaggcccctgtgcccccaggagaagaagaggcacgtggacctgaataagaggttccacaacatctccggaagatgggccggaagatgcgccgcctgttggaggagcagggcccctgtgaagcagaccctgaacttcgacctgctgaagctggccggcgacgtggagagcaatcccggccctgaccccaagcagaggccctacaagctgcccgacctgtgcaccgagctgaacaccagcctgcaggacgtgtccatcgcctgcgtgtactgcaaggccaccctggagaggaccgaggtctaccagttcgccttcaaggacctgtgcatcgtgtacagggactgcatcgcctacgccgcctgccacaagtgcatcgacttctacagcaggatcagggagctgaggtactacagcaacagcgtgtacggcgagaccctggagaagatcaccaacaccgagctgtacaacctgctgatcaggtgcctgaggtgccagaagcccctgaaccctgccgagaagaggaggcacctgaaggacaagaggagattccacagcatcgccggacagtacaggggccagtgcaacacctgctgcgaccaggccgcccctgtgaagcagaccctgaacttcgacctgctgaagctggccggcgacgtggagagcaatcccggccctgaccctgccaccaggcctaggaccctgcacgagctctgcgaggtgctggaggagagcgtgcacgagatcaggctgcagtgcgtgcagtgcaagaaggagctgcagaggagggaggtgtacaagttcctgtttaccgacctgaggatcgtgtacagggataacaacccctacggcgtgtgcatcatgtgcctgaggttcctgagcaagatcagcgagtacaggcactaccagtacagcctgtacggcaagaccctggaggagagggtgaagaagcccctgagcgagatcaccatcaggtgcatcatctgccagacccccctgtgtcccgaagagaaggagaggcatgtgaacgccaacaagaggttccataacatcatgggcaggtggaccggcagatgcagcgagtgctggaggcctagggcccctgtgaagcagaccctgaacttcgacctgctgaagctggccggcgacgtggagagcaatcccggccctgacgccgaggagaagcccaggaccctgcacgacctgtgccaggctctggagaccagcgtgcacgagatcgagctgaagtgcgtggagtgcaagaagaccctgcagaggagcgaggtgtacgacttcgtgttcgccgacctgaggatcgtgtacagggacggcaaccctttcgccgtgtgcaaggtgtgcctgaggctgctgagcaaaatcagcgagtacaggcactacaactacagcctgtacggcgacaccctggagcagaccctgaagaagtgcctgaacgagatcctgatcaggtgcatcatctgccagaggcccctgtgcccccaggagaagaagaggcacgtggacctgaacaagaggttccacaacatcagcggcaggtggaccggcaggtgtgctgtgtgctggaggcccaggtga

SEQ ID NO: 128 - DNA, 6864 bp, artificial
  synthetic polynucleotide
atggccaaagccgccatgctggccaagtttaaggagctgtacggagtgtccttctccgaactggtgagacctttcaagagcaacaaatccacctgttgtgactggtgtatcgccgccttcggcctgacccccagcatcgctgatagcattaaaacactgctgcagcagtactgtctgtatctgcacatccaatccctggcttgttcctggggaatggtcgtgctcctgctggtgaggtacaaatgcggcaagaatagagagacaatcgaaaagctgctgtccaagctgctgtgtgtctcccctatgtgcatgatgatcgagccccctaaactcagatccacagccgctgccctctactggtataagacaggcatcagcaatatttccgaggtgtacggagacacacctgaatggattcaaaggcagaccgtgctgcagcactccttcaacgactgcacatttgagctgtcccaaatggtgcaatgggcctacgacaatgacattgtggacgactccgaaattgcttataagtatgctcaactcgccgataccaatagcaacgcctccgctttcctgaagagcaactcccaggccaagatcgtcaaggactgtgccaccatgtgtaggcattataaaagagctgagaaaaagcaaatgagcatgtcccagtggattaagtacaggtgcgacagggtcgatgacggcggcgattggaagcagatcgtgatgttcctcaggtaccagggagtcgagtttatgtccttcctcaccgccctcaaaagattcctgcagggcatccccaagaagaactgcattctgctgtatggagccgccaacaccggcaaatccctctttggaatgagcctcatgaagttcctccagggcagcgtgatctgtttcgtgaatagcaaatcccacttctggctccagcctctggctgatgccaaaattggtatgttagatgacgccaccgtgccttgttggaactatattgacgacaacctcagaaatgccctcgatggcaacctcgtcagcatggacgtcaagcacagacctctggtccaactgaaatgcccccccctgctcatcaccagcaacatcaatgccggcaccgattccaggtggccttacctgcacaacaggctcgtcgtgttcacatttcccaacgagtttccctttgatgaaaacggcaaccctgtgtacgagctcaatgacaagaactggaagtcctttttcagcagaacctggtccaggctgtccctcggaggaggaggcggaaaacagggcgctatgctcgccgtgttcaaggacacctacggcctctccttcacagacctcgtcagaaacttcaaaagcgataaaaccacctgtacagattgggtgaccgccatctttggagtgaatcctaccatcgccgagggctttaagacactgatccagcccttcatcctgtacgctcatattcagtgtctggactgtaaatggggcgtcctcatcctcgccctgctgagatataagtgtggaaaaagcaggctcacagtcgctaagggcctcagcaccctgctgcacgtccctgaaacctgtatgctgatccaacctcccaaactgagatcctccgtggccgccctctattggtatagaacaggcatcagcaatatctccgaagtcatgggcgacacccccgagtggattcaaaggctcaccattattcagcacggcatcgatgatagcaatttcgatctcagcgaaatggtgcaatgggcctttgacaatgagctcaccgacgagagcgacatggccttcgaatatgctctcctcgctgactccaactccaacgccgctgccttcctcaagagcaattgccaggctaaatacctgaaagactgcgccaccatgtgcaagcactataggagggcccaaaaaaggcaaatgaatatgagccagtggatcaggttcaggtgtagcaagattgacgagggcggcgactggaggcctattgtgcagttcctgagataccagcagattgagttcatcacctttctcggcgctctgaagtcctttctgaagggcacacctaaaaaaaattgtctcgtcttttgcggccccgctaacacaggaaaaagctacttcggaatgagctttatccactttattcagggagctgtcattagctttgtgaacagcacatcccatttttggctcgagcctctgaccgacacaaaggtcgctatgctcgatgacgctaccaccacatgttggacctactttgatacatatatgaggaacgctctcgacggaaatcccatctccattgacagaaagcacaagcccctcatccagctgaagtgtcctcctattctcctgacaaccaatatccatcccgctaaggataataggtggccttacctggagagcaggattaccgtcttcgaatttcccaacgccttccccttcgataaaaacggaaaccccgtgtatgagattaatgataaaaactggaaatgtttcttcgaaagaacatggtccaggctcgatctcggaggcggcggcggaggcaaggctgccatgctcggcaaattcaaggagctctacggcgtgagctttatggaactgattaggcccttccaaagcaacaagagcacctgcacagactggtgtgtggccgcttttggcgtgacaggcaccgtggccgaaggattcaagacactgctccagccttactgcctctattgccacctccagtccctggcctgcagctggggcatggtgatgctgatgctggtgagattcaagtgcgccaagaacaggatcacaattgaaaaactgctggagaagctgctctgcatttccaccaattgtatgttaatccaacctcctaaactcaggagcaccgccgctgccctgtactggtatagaaccggcatgtccaatatcagcgacgtgtatggagagacccctgagtggatcgagagacagaccgtcctgcagcacagctttaacgacacaacctttgatctgagccagatggtccagtgggcttatgacaacgacgtgatggacgacagcgagatcgcttacaagtacgctcagctcgccgatagcgattccaatgcctgtgccttcctgaaatccaactcccaggctaagatcgtgaaggattgcggcacaatgtgcaggcactataagagggccgagaagagacagatgagcatgggccaatggattaaaagcagatgtgacaaggtgtccgacgagggcgattggagggacattgtgaagtttctgagataccaacagatcgaatttgtgtccttcctctccgccctcaagctgtttctcaagggcgtgcctaagaagaattgcatcctcatccacggagctcctaacacaggcaaatcctatttcggaatgtccctcatctcctttctccaaggatgcatcatttcctatgctaactccaaaagccacttttggctgcaacctctggccgacgctaaaatcggtatgttagacgacgctaccacaccctgttggcactatatcgacaattacctcaggaacgctctggatggaaaccctgtctccatcgacgtcaagcacaaagccctcatgcaactgaaatgccctcctctgctgatcaccagcaatatcaacgctggcaaggacgacaggtggccttatctgcactccaggctcgtggtctttaccttccccaacccctttccttttgacaagaatggaaaccccgtctacgaactctccgacaaaaactggaagtccttcttcagcaggacatggtgcaggctgaacctgggcggcggaggcggcacaaaggccaacattctgtacaagttcaaggaggcctacggcatcagctttatggagctggtgagacccttcaagagcgataagacctcctgcaccgactggtgcattaccggatatggcatttcccccagcgtggccgagtccctgaaggtgctgatcaaacagcacagcctgtacacccacctgcaatgtctgacatgcgacagaggcatcatcatcctgctgctcattagatttaggtgcagcaaaaacaggctcacagtggccaaactcatgagcaatctgctgagcattcccgagacatgcatggtgatcgaaccccccaaactgaggagccaaacctgcgccctgtattggttcaggacagccatgagcaacatttccgacgtccagggcacaacccctgaatggattgacagactgaccgtgctccagcattcctttaacgataatatcttcgatctctccgagatggtgcagtgggcctacgataacgagctgaccgatgacagcgacatcgcttattactacgcccaactcgccgactccaattccaatgccgccgcttttctgaaaagcaacagccaagctaaaatcgtcaaagactgtggcatcatgtgcaggcattataagaaagccgagaagaggaagatgagcatcggccagtggattcagagcaggtgcgagaaaaccaacgatggcggaaactggaggcccatcgtgcagctcctgaggtatcagaacattgagttcaccgcttttctcggagccttcaaaaaatttctgaagggaatccctaagaaatcctgtatgttaatctgcggccctgctaacaccggaaagagctatttcggcatgagcctgatccaattcctcaaaggctgcgtgatttcctgtgtgaacagcaagagccatttctggctgcagcctctgtccgatgccaagatcggaatgattgatgacgtgacccctatcagctggacctacatcgacgattatatgagaaatgccctggacggcaacgaaatcagcattgacgtcaagcacagggccctggtccagctgaaatgtccccctctcctcctcacatccaacaccaacgctggaaccgactccaggtggccctacctccattccagactcaccgtcttcgagtttaaaaatcccttccccttcgatgagaatggaaatcctgtgtatgccattaacgacgagaactggaagagcttttttagcaggacctggtgcaaactcgacctgggaggcggaggaggaaaaaaagctgccatgctggccgtcttcaaagacatctatggactctcctttaccgatctggtcagaaatttcaagtccgacaagacaacctgcaccgattgggtgatggccatcttcggagtcaaccccaccgtggctgaaggctttaagaccctcatcaaacctgccaccctgtatgctcacatccaatgcctggattgtaagtggggagtgctcatcctggccctcctcaggtacaagtgtggaaagaacaggctgaccgtggctaaaggcctctccaccctgctccacgtgcctgagacctgtatgctgatcgagccccccaagctgaggtcctccgtcgctgctctgtattggtacagaaccggcatctccaacatctccgaggtcagcggcgatacccccgagtggattcaaaggctgacaattatccagcacggaatcgatgactccaactttgacctctccgacatggtccaatgggctttcgacaacgatctcaccgatgagagcgatatggcctttcagtacgcccagctggctgattgtaattccaacgccgccgccttcctgaaaagcaattgtcaggctaagtacctcaaggactgcgctgtgatgtgtagacactacaaaagagctcagaaaaggcagatgaatatgtcccagtggattaaatataggtgttccaagatcgacgagggaggcgattggagacccatcgtccagtttctcagataccagggagtggagtttatctcctttctgagagccctgaaggagtttctgaaaggaacacctaagaaaaattgtatcctcctgtatggccctgccaatacaggaaagtcctattttggaatgtcctttatccattttctgcaaggcgctattatcagcttcgtgaacagcaactcccatttttggctcgaacctctggctgacaccaaagtggccatgctcgatgatgccacccacacctgctggacctattttgacaactacatgaggaacgccctggatggcaaccccatttccatcgacagaaagcataagcctctcctccaactgaagtgccctcctattctgctcaccagcaacatcgatcccgccaaggacaacaaatggccttacctcgagtccagggtgaccgtgtttacattcccccacgccttcccctttgacaagaacggcaaccccgtgtacgaaattaatgataaaaattggaagtgcttctttgaaagaacctggagcaggctcgacctcggaggaggcggaggaagggcccactataacatcgtgaccttttgctgcaaatgcgacagcaccctgaggctctgcgtccagagcacacacgtcgacattagaacactggaagacctcctcatgggaacactcggcattgtgtgtcccatttgcagccagaagcctaccctccatgagtatatgctggacctgcaacccgagacaaccgacctctatggctaccagcagctcggaggaggcggaggcaggcacaccatgctctgtatgtgttgtaaatgtgaagccagaatcaaactggtggtcgagagctccgctgatgatctcagggcctttcagcaactcttcctcaacaccctgtccttcgtgtgcccttggtgtgcctcccagcagaccctgcaggacattgtcctgcacctggagcctcagaatgagattcccgtggatctcctgggccatcagcagctcagcgactccgaagaagagaatgatgaaatcgactga

SEQ ID NO: 129 - DNA, 7206 bp, artificial
  synthetic polynucleotide
atggccaaagctgctatgctcgccaagttcaaagagctctacggcgtctccttctccgaactcgtcagacctttcaagtccaataaaagcacctgctgtgactggtgcattgccgcctttggactgacacctagcatcgccgattccattaagaccctgctccaacagtattgtctgtacctccacatccagtccctggcctgcagctggggaatggtcgtcctgctgctcgtgaggtataaatgtggcaaaaacagggagaccatcgagaagctgctcagcaagctgctgtgtgtgtcccccatgtgcatgatgatcgagcctcctaagctcagatccacagccgccgccctctattggtacaagaccggcattagcaatatctccgaggtgtacggagacacccctgagtggattcaaagacaaacagtgctgcaacatagcttcaatgattgtacatttgagctgtcccaaatggtgcaatgggcctatgacaacgacatcgtcgacgatagcgaaatcgcctacaaatatgcccagctcgccgacaccaattccaacgcttccgcctttctgaagagcaactcccaagccaaaatcgtcaaggactgcgctaccatgtgcagacattacaagagggctgagaaaaagcagatgtccatgagccagtggattaagtacaggtgcgatagagtggacgatggcggagattggaagcagatcgtgatgtttctgcgttatcaaggcgtggagtttatgagcttcctcaccgctctcaagaggtttctgcagggcattcctaagaaaaattgtattctgctgtatggagccgccaatacaggcaagtccctgttcggcatgtccctgatgaagtttctgcaaggcagcgtcatctgcttcgtgaacagcaagtcccacttctggctgcaacccctggctgacgccaaaattggaatgctcgacgatgccaccgtgccctgttggaattatatcgatgacaatctgaggaatgccctggatggaaacctggtgagcatggatgtcaagcacagacctctggtgcagctcaagtgtccccccctcctgattacctccaatattaacgctggcacagatagcaggtggccctatctgcataacaggctggtcgtgtttaccttccccaatgagttccccttcgatgagaatggaaatcccgtctatgagctgaatgataaaaactggaagagcttcttcagcaggacatggagcaggctgtccctggcccctgtgaagcagaccctgaacttcgacctgctgaagctggccggcgacgtggagagcaatcccggccctaaacagggagctatgctggccgtcttcaaggacacctatggcctgtccttcaccgacctggtgagaaactttaagtccgacaagacaacctgcacagattgggtgacagccattttcggcgtgaaccccaccatcgctgaaggcttcaaaaccctgatccagccttttatcctgtacgcccacatccaatgcctggattgtaagtggggagtgctcatcctcgccctgctgagatataaatgcggaaagtccagactgacagtcgccaagggcctcagcacactgctgcatgtgcctgaaacctgtatgttaatccaaccccctaaactgagaagcagcgtggccgccctgtactggtacaggacaggcatcagcaatatcagcgaagtcatgggcgacacccccgaatggattcaaaggctcaccattatccaacacggcatcgacgactccaattttgatctcagcgagatggtgcaatgggcctttgacaacgagctgaccgatgaatccgacatggctttcgagtacgccctcctggctgacagcaactccaatgccgctgcttttctcaagagcaactgccaggctaaatacctgaaagactgcgccaccatgtgtaagcactataggagggcccaaaaaaggcaaatgaacatgagccaatggattagattcaggtgtagcaagattgacgaaggaggcgattggaggcccattgtccaattcctgagataccagcagatcgaatttattaccttcctgggcgccctgaagtcctttctgaagggaacccctaagaagaactgcctggtcttctgtggccctgccaacaccggaaagtcctacttcggcatgagctttattcatttcattcagggagctgtgatcagcttcgtcaattccaccagccacttctggctggagcccctgaccgacaccaaggtcgccatgctggatgacgccacaaccacatgctggacctatttcgatacctatatgaggaatgctctggatggcaatcctattagcatcgacaggaaacacaagcctctgattcagctgaagtgtcctcccattctgctgaccaccaacattcaccctgctaaggacaatagatggccctatctggagagcaggattaccgtgttcgaatttcctaacgcctttccctttgacaaaaatggcaatcctgtgtatgaaatcaatgacaaaaactggaagtgcttcttcgaaagaacctggtccagactcgatctcgcccctgtgaagcagaccctgaacttcgacctgctgaagctggccggcgacgtggagagcaatcccggccctggaaaagccgctatgctcggcaaattcaaggaactctacggagtcagctttatggagctgatcaggcccttccagtccaacaagtccacatgcacagactggtgcgtcgctgcctttggcgtgacaggcacagtggctgagggctttaagacactcctgcaaccctactgcctctactgccatctccagagcctcgcttgctcctggggaatggtgatgctcatgctcgtcaggttcaagtgcgccaagaacagaattaccattgagaaactcctggaaaaactgctctgcattagcaccaattgtatgttaattcagcctcccaagctgagaagcaccgccgctgccctctactggtataggacaggaatgagcaacatctccgatgtgtatggcgaaacccctgaatggatcgagaggcaaacagtcctccagcatagctttaatgacaccacattcgacctcagccagatggtccaatgggcctatgataacgacgtgatggacgacagcgagatcgcctataaatacgctcagctcgccgatagcgactccaatgcctgtgcttttctgaagtccaacagccaagctaagatcgtcaaagattgtggcaccatgtgtagacattataagagggctgaaaaaagacagatgagcatgggccaatggatcaaatccagatgcgataaggtcagcgacgaaggagattggagggacatcgtcaagtttctgaggtaccaacagatcgaattcgtctcctttctcagcgccctcaagctgtttctgaagggcgtccccaaaaagaattgtatcctgatccatggagcccccaataccggcaagagctatttcggaatgagcctgatttccttcctgcaaggctgcatcatctcctacgccaacagcaaaagccatttttggctgcagcctctggctgacgctaagatcggtatgttagacgacgccaccaccccttgctggcattacatcgacaattatctgagaaacgctctggacggcaaccctgtctccattgacgtcaagcacaaggccctgatgcaactcaaatgcccccctctgctgatcacaagcaacatcaacgccggaaaggacgataggtggccctatctccacagcagactggtggtgtttacattccctaatccttttccctttgataagaatggcaaccccgtctacgagctgtccgataagaattggaagagctttttcagcagaacctggtgcaggctgaacctggcccctgtgaagcagaccctgaacttcgacctgctgaagctggccggcgacgtggagagcaatcccggccctaccaaagccaacatcctctacaagttcaaggaggcctacggaattagcttcatggagctggtcaggccctttaagagcgacaagacctcctgtaccgattggtgtattacaggctacggcatttccccttccgtggctgagagcctgaaggtgctgatcaagcaacactccctgtatacccatctgcaatgcctcacctgcgacagaggaatcattatcctgctgctcattagatttaggtgttccaaaaatagactgaccgtcgccaaactgatgtccaacctgctctccatccccgaaacctgtatggtcatcgagccccctaagctgaggtcccagacatgcgctctctactggttcagaaccgctatgtccaacatcagcgatgtgcaaggcacaacacctgagtggatcgataggctgaccgtcctccaacacagcttcaatgacaacatctttgacctcagcgaaatggtccagtgggcctacgataacgaactgaccgacgactccgacattgcctactactacgcccaactcgccgacagcaacagcaacgccgctgccttcctcaaaagcaacagccaggccaaaattgtgaaagattgcggaatcatgtgcagacattataagaaggctgagaaaagaaaaatgtccatcggccagtggattcaatccaggtgcgaaaagacaaacgatggcggcaactggaggcctattgtccagctcctgagataccaaaacatcgagtttaccgctttcctgggcgctttcaagaagtttctgaaaggaattcctaagaagtcctgtatgctcatttgcggccccgctaataccggaaagagctattttggaatgtccctgatccaattcctgaagggatgcgtgatcagctgcgtgaattccaagagccacttctggctccagcctctgtccgatgctaaaatcggcatgatcgacgacgtgacacccattagctggacctacatcgacgactacatgagaaacgctctggacggaaatgagatcagcatcgacgtgaagcatagagctctggtgcaactgaagtgccctcccctgctgctgacctccaataccaatgctggcaccgacagcagatggccctacctgcatagcaggctgaccgtgtttgagtttaagaatcccttcccctttgacgagaacggaaaccccgtgtacgccattaatgacgaaaactggaaatcctttttttccaggacctggtgtaagctcgacctcgcccctgtgaagcagaccctgaacttcgacctgctgaagctggccggcgacgtggagagcaatcccggccctaaaaaggccgccatgctggctgtgttcaaagacatttatggactgagcttcacagacctggtcaggaacttcaaaagcgataagacaacctgtacagattgggtcatggccattttcggagtgaatcccaccgtggctgagggattcaaaacactcattaaacccgctacactgtacgctcacatccagtgcctggattgcaagtggggcgtcctcatcctcgccctgctcaggtacaaatgcggcaagaacagactgaccgtggccaaaggcctgagcaccctcctccacgtccccgagacctgtatgttaattgagcctcctaaactgaggtcctccgtggccgccctgtattggtacagaacaggaatctccaatatctccgaagtgagcggagatacacccgagtggattcaaagactcacaatcatccaacacggaatcgatgattccaactttgacctctccgatatggtgcagtgggccttcgataacgatctcaccgatgagagcgacatggcctttcagtatgcccaactggccgactgtaatagcaatgccgccgccttcctgaaaagcaattgtcaggccaagtacctgaaggactgcgccgtcatgtgcaggcactataaaagagcccagaagagacaaatgaatatgtcccaatggattaaatacaggtgttccaagatcgatgaaggaggagactggaggcccatcgtccagttcctgcgttatcaaggcgtggaattcatcagctttctgagagccctcaaggaatttctcaaaggaacacccaagaaaaattgcatcctcctctatggacccgctaacacaggcaaaagctactttggcatgagcttcatccacttcctccaaggcgctatcatctcctttgtcaacagcaatagccatttttggctcgagcccctggccgatacaaaagtggccatgctggacgatgctacacacacatgttggacatattttgacaattacatgaggaatgctctggatggcaatcccatcagcattgataggaagcataagcccctcctgcaactgaaatgccctcccattctgctcaccagcaacatcgatcctgctaaagacaacaagtggccttacctcgaaagcagggtcaccgtgttcacattcccccacgctttcccttttgacaagaacggcaaccccgtctatgagatcaacgataaaaattggaaatgcttttttgagaggacatggtccaggctcgacctggcccctgtgaagcagaccctgaacttcgacctgctgaagctggccggcgacgtggagagcaatcccggccctagggcccactataatatcgtcacattttgttgcaagtgtgattccacactcaggctgtgcgtccaaagcacccacgtggacatcaggaccctcgaggacctcctgatgggcacactgggaattgtgtgtcccatctgtagccaaaagcccaccctccatgagtatatgctggacctccagcctgagacaacagacctgtacggctatcagcaactggcccctgtgaagcagaccctgaacttcgacctgctgaagctggccggcgacgtggagagcaatcccggccctaggcacaccatgctgtgcatgtgctgcaaatgcgaggccagaatcaaactggtcgtggagtcctccgctgatgacctcagagccttccaacagctgttcctcaacacactcagcttcgtgtgcccctggtgtgcctcccagcagaccctgcaggacattgtcctgcacctcgaaccccaaaatgagatccccgtggacctgctcggccaccaacagctgtccgattccgaggaggagaatgatgagatcgattga

SEQ ID NO: 130 - DNA, 7008 bp, artificial
  synthetic polynucleotide
atggagaccctgtgccagaggctcaatgtctgccaggacaaaatcctgacacattacgagaatgatagcaccgacctgagggaccacattgactactggaaacacatgaggctggagtgcgccatctactataaggctagagagatgggcttcaaacacattaatcaccaggtggtgcctacactcgccgtgtccaagaataaagccctccaggctatcgagctgcagctcaccctggagacaatttacaatagccagtatagcaacgagaagtggaccctgcaggacgtgtccctggaggtctacctgacagctcctaccggctgtatcaagaagcatggctacaccgtggaagtgcagtttgacggcgacatttgtaataccatgcattacaccaattggacacacatttacatctgtgaggaagcctccgtgaccgtggtggaaggacaggtcgactactatggactgtactacgtgcacgagggaatcagaacctacttcgtccagtttaaggacgacgccgagaaatactccaagaacaaggtgtgggaagtgcacgccggcggacaggtgattctgtgtcctacatccgtctttagcggcggcacaggaggctccacaacacccattgtgcacctgaagggagatgctaacacactcaaatgtctgagatacaggtttaagaagcattgcacactctatacagccgtgagcagcacctggcattggaccggacacaatgtgaagcacaaaagcgccattgtgacactgacctatgacagcgagtggcagagggaccagtttctctcccaggtgaagattcccaagacaatcaccgtgagcacaggcttcatgagcatcggcggaggcggcggtatgcaaacacccaaagagacactctccgagagactgtcctgcgtccaagataagatcattgaccactacgaaaatgattccaaggacattgattcccagatccagtactggcagctcatcaggtgggaaaacgccattttcttcgccgccagggaacatggaatccagaccctcaaccaccaagtggtgcctgcttacaacatctccaaatccaaggcccataaagctattgagctgcaaatggccctccagggactggctcagagcgcttacaaaaccgaagattggaccctgcaagacacatgcgaagagctctggaatacagaacctacccactgcttcaagaaaggaggccagaccgtccaggtctacttcgacggaaacaaagacaactgtatgacctacgtggcctgggattccgtgtactacatgaccgacgctggcacctgggacaagaccgctacatgtgtcagccataggggcctgtactacgtcaaagagggctataacaccttttacatcgaatttaaatccgaatgcgaaaagtacggaaataccggaacctgggaggtgcattttggcaataacgtgattgactgtaacgacagcatgtgcagcggaggcaccggaggcagcacaacccctattattcatctgaagggcgatagaaatagcctgaaatgtctcaggtacagactgagaaagcactccgatcactacagagacattagctccacctggcactggacaggcgccggaaacgaaaagaccggaatcctgaccgtgacctaccattccgagacccagaggaccaagttcctcaatacagtcgctatccctgattccgtccaaatcctggtgggctatatgaccatgggcggcggcggaggcatggaggaaatctccgctagactgaatgctgtgcaagagaaaatcctcgacctgtacgaagctgacaagaccgacctcccctcccaaatcgaacattggaagctcatcaggatggagtgtgccctcctctacacagctaaacagatgggattttcccacctgtgccatcaggtcgtccctagcctcctggccagcaagacaaaagcttttcaggtcattgaactccagatggctctggagaccctgagcaagtcccagtacagcaccagccagtggaccctccaacagacatccctcgaagtgtggctctgtgagcctcccaaatgcttcaaaaagcagggcgagacagtgaccgtgcagtatgataatgacaagaagaatacaatggattacaccaattggggcgaaatttatattatcgaagaggatacctgcacaatggtgaccggcaaggtggattacatcggcatgtactacattcataattgtgaaaaagtctacttcaaatacttcaaggaggatgctgctaagtactccaaaacccaaatgtgggaggtgcacgtcggcggccaggtcatcgtgtgccctacatccatttccagcggaggaacaggaggctccgtggcccctatcgtgcatctcaagggcgagagcaacagcctcaaatgcctcaggtatagactgaagccctacaaggagctgtattccagcatgagcagcacctggcactggaccagcgacaacaagaattccaagaacggcatcgtcacagtcacctttgtcaccgagcagcagcagcaaatgtttctgggaacagtcaaaatcccccccacagtccagattagcacaggattcatgacactgggaggcggaggcggaatggagtccatccctgctagactcaatgctgtgcaggaaaagatcctcgatctgtatgaagctgactccaacgacctgaacgctcaaatcgagcactggaagctcaccagaatggaatgtgtgctgttttataaggccaaggagctgggcatcacccatatcggacaccaagtggtcccccccatggctgtgagcaaggctaaggcttgtcaggccattgagctccagctcgctctggaggccctgaacaagacccagtattccacagatggatggacactgcaacagacaagcctcgagatgtggagggctgagccccagaagtactttaagaaacatggatataccattacagtgcagtatgacaacgacaaaaacaacacaatggattataccaattggaaggagatctacctgctgggcgagtgtgagtgtaccattgtcgagggccaagtcgactattatggactgtattattggtgcgacggcgagaagatttacttcgtgaaattcagcaatgacgctaaacaatactgcgtgacaggcgtctgggaggtccatgtcggcggccaagtcatcgtgtgtcctgcttccgtgtcctccggaggcacaggaggttctacagcccccattatccatctgaaaggcgaccccaattccctgaagtgcctgagatacagagtgaagacacacaagagcctctacgtgcagatctcctccacatggcactggacatccaacgagtgtacaaacaataaactgggcatcgtgacaatcacctactccgacgagacacagagacaacagttcctcaagaccgtcaagatccctaacaccgtccaagtgatccaaggcgtcatgagcctcggcggcggcggaggaatggaagaaatttccgccagactgagcgccgtccaagacaagatcctggacatctatgaggccgataaaaacgatctgaccagccagatcgaacactggaaactgattagaatggaatgcgctatcatgtataccgccaggcaaatgggcatctcccacctgtgtcatcaggtggtgcccagcctggtcgcctccaagaccaaggccttccaagtcatcgaactgcagatggccctggagacactcaatgcctccccttataagaccgatgagtggacactccagcaaacaagcctggaggtgtggctgtccgagcctcagaaatgctttaagaaaaagggcatcaccgtcaccgtccagtacgataacgataaggctaacaccatggactataccaactggtccgagatttacattattgaagagacaacctgcacactggtggccggcgaggtggactatgtcggactgtattacatccacggcaacgaaaaaacctatttcaagtacttcaaagaggacgctaagaaatacagcaagacccagctctgggaagtccacgtcggcagcagagtcattgtgtgccctacctccatcccttccggcggaacaggcggctccgtctcccctattgtccacctgaaaggcgatcccaactccctcaaatgcctgagatataggctcaaacccttcaaggacctgtactgcaatatgagcagcacctggcattggacctccgatgacaagggagacaaggtgggcattgtgacagtcacatacaccaccgagacacaaaggcagctcttcctgaacaccgtgaaaattcctcccaccgtccagatctccaccggcgtgatgagcctgggaggcggaggaggagatccccaggagagacctagaaagctgcctcaactctgcacagagctgcagaccacaattcacgacattatcctggaatgcgtctattgcaagcaacaactgctcaggagggaggtctacgatttcgcctttagggatctgtgtatcgtgtacagggatggaaacccctacgccgtctgtgacaagtgcctgaagttctactccaagatctccgaatacaggcactactgttacagcctctatggcaccacactggaacaacagtacaacaagcccctctgcgatctcctcatcaggtgcattaactgtcagaagcctctgtgccccgaagagaaacaaaggcacctggataagaagcagaggtttcacaacatcagaggcaggtggacaggcaggtgcatgagctgctgcagaagctccggaggaggcggaggagaccctaccagaaggccctataaactccctgatctgtgtaccgagctgaacaccagcctgcaggacattgagatcacctgtgtgtattgtaaaacagtgctggaactgaccgaggtctttgagttcgcctttaaggacctcttcgtcgtctatagggactccatccctcacgccgcctgtcataaatgtattgatttctatagcaggatcagggagctgagacactatagcgactccgtctatggcgataccctggaaaagctgaccaatacaggcctgtacaatctgctgatcaggtgtctgaggtgtcagaagcccctcaaccccgccgagaagctgagacacctcaatgaaaagaggagattccataatatcgctggacattacagaggacagtgccacagctgctgcaacagagctggaggcggaggaggaaaccctgctgagagacctaggaaactgcacgaactgagctccgctctggaaattccctatgacgagctgaggctgaactgcgtgtactgcaaaggccagctgacagagacagaggtgctcgacttcgcttttaccgatctcaccattgtgtacagagacgacacccctcatggcgtctgcacaaagtgcctcaggttctacagcaaggtcagcgagtttagatggtataggtactccgtgtatggaaccaccctggagaagctgacaaacaagggaatctgtgacctcctgatcaggtgcatcacctgccagagacccctgtgtcctgaggagaagcaaagacacctggacaagaagaaaaggttccataacatcggcggaagatggacaggcaggtgcatcgcctgctggaggaggcccggcggcggcggcggcgaccctaagcaaagaccttacaaactgcctgacctgtgcaccgagctgaataccagcctgcaagatgtgagcatcgcttgcgtctactgcaaagctaccctggaaaggaccgaggtctaccagtttgctttcaaggacctctgtattgtctacagggactgcatcgcttacgctgcctgccacaagtgcatcgatttctattccaggattagagaactgagatactacagcaacagcgtgtacggcgaaacactggaaaaaatcaccaataccgagctgtacaacctgctgatcagatgcctcaggtgccaaaagcctctgaaccctgccgagaaaaggagacatctgaaggacaaaagaaggttccacagcatcgctggacagtatagaggccagtgcaacacctgctgcgatcaagctggaggcggcggaggagatcccgccacaagacctagaacactccacgaactgtgcgaggtcctggaggagtccgtgcacgagattaggctgcaatgtgtgcaatgcaagaaggagctccagaggagagaggtctataaattcctcttcaccgatctcaggattgtgtacagggataacaacccctacggcgtctgtatcatgtgtctgagattcctgagcaagattagcgagtataggcactaccagtactccctctatggaaagaccctcgaagaaagagtcaaaaagcccctgtccgagatcacaattagatgtatcatctgccagacccccctgtgccctgaagagaaggagaggcatgtgaatgccaataaaaggttccacaatatcatgggcaggtggaccggcagatgcagcgaatgctggaggcctaggggaggaggaggaggagacgccgaagagaagcccagaacactgcacgacctctgtcaggccctggaaacaagcgtccacgaaatcgagctcaaatgtgtggaatgcaagaaaaccctgcagaggagcgaggtgtacgattttgtgtttgccgacctcaggatcgtgtatagggacggaaacccctttgccgtgtgcaaggtgtgtctcagactgctcagcaaaatcagcgaatacagacactataactacagcctgtacggcgatacactcgagcagaccctgaagaagtgcctcaacgaaattctgatcagatgtattatttgccagaggcctctgtgtccccaagagaaaaaaaggcacgtcgacctgaacaagaggtttcataatatctccggaagatggaccggcagatgcgccgtgtgctggagacccaggtga

SEQ ID NO: 131 - DNA, 7578 bp, artificial
  synthetic polynucleotide
atggagaccctctgtcaaaggctgaatgtctgtcaagacaaaatcctcacccactacgagaacgacagcacagacctgagagatcatatcgattactggaagcacatgaggctggagtgtgccatctactacaaggccagagagatgggcttcaaacatattaaccaccaggtggtccccaccctggctgtcagcaaaaataaagccctccaagccattgaactgcaactgaccctggaaaccatttataattcccaatactccaacgagaaatggaccctccaggatgtgtccctcgaagtctacctgaccgcccccaccggatgcatcaagaagcatggctataccgtcgaggtgcaattcgacggcgacatttgcaacaccatgcactacaccaactggacacatatttatatttgtgaggaagcctccgtgaccgtggtggaaggccaggtggattattacggcctctactacgtgcatgaaggaatcagaacatactttgtccagttcaaggatgatgccgagaaatattccaaaaacaaggtgtgggaggtccacgccggcggccaagtgattctctgtcctacatccgtcttcagcggcggcaccggaggctccaccacccctatcgtgcatctcaagggcgatgctaataccctgaaatgtctcaggtataggtttaaaaagcattgtaccctgtacacagctgtcagctccacatggcactggacaggacataacgtgaagcacaagtccgccatcgtgaccctgacctatgactccgaatggcagagagaccagtttctgagccaagtgaaaatccctaaaaccatcaccgtgtccaccggcttcatgtccatcgcccctgtgaagcagaccctgaacttcgacctgctgaagctggccggcgacgtggagagcaatcccggccctatgcaaacccctaaagaaaccctcagcgagaggctgtcctgcgtccaagataaaattatcgaccattacgagaacgattccaaagatattgactcccaaattcaatactggcaactgatcagatgggaaaacgccatcttcttcgctgccagagaacatggaatccagaccctcaatcatcaagtggtccctgcctacaacattagcaaatccaaagctcataaagctattgagctgcagatggccctgcaaggcctggctcagtccgcttataaaaccgaggactggacactccaagacacctgcgaagagctgtggaataccgagcctacccattgtttcaagaagggaggccagaccgtgcaggtctactttgatggcaataaggataattgcatgacctacgtcgcctgggactccgtgtactatatgacagacgccggcacctgggataaaacagccacctgcgtctcccataggggactgtattatgtcaaggagggatataacacattctacatcgagttcaagtccgagtgcgagaagtatggaaataccggcacctgggaagtgcacttcggcaacaatgtcatcgattgcaacgacagcatgtgtagcggcggcaccggaggctccacaacccccatcatccatctgaaaggcgacaggaatagcctcaagtgcctcagatacaggctgaggaaacacagcgatcactatagagacatttcctccacctggcactggaccggcgccggcaatgaaaaaaccggcattctcacagtgacataccactccgagacccagaggaccaaattcctgaacacagtcgccatccctgactccgtccagatcctggtgggctacatgaccatggcccctgtgaagcagaccctgaacttcgacctgctgaagctggccggcgacgtggagagcaatcccggccctatggaagagatcagcgccaggctgaatgccgtccaagaaaaaatcctcgacctgtacgaggctgacaagaccgatctgccctcccaaatcgaacattggaagctcatcagaatggagtgcgccctcctgtacaccgctaaacagatgggattcagccatctgtgccatcaggtcgtgccctccctcctggccagcaagaccaaggcctttcaggtgattgaactgcagatggctctggagaccctgagcaagtcccagtattccacatcccagtggacactccagcaaacaagcctggaagtgtggctctgcgaaccccctaagtgcttcaagaagcaaggcgagaccgtcaccgtccaatatgacaacgataagaaaaataccatggactacaccaattggggcgaaatctacattattgaagaagatacctgcaccatggtcacaggcaaggtcgactatatcggcatgtattacattcataattgcgaaaaagtgtactttaagtactttaaggaggacgccgccaagtactccaagacccagatgtgggaggtccacgtgggcggccaggtgattgtgtgccctacctccatcagcagcggcggaacaggcggaagcgtcgcccccattgtgcatctgaagggagaaagcaatagcctgaagtgcctcaggtataggctgaagccttacaaggagctctatagctccatgagcagcacatggcattggaccagcgacaacaagaatagcaaaaacggaattgtcaccgtgacatttgtcacagagcagcagcagcaaatgttcctgggaaccgtgaagattccccccacagtgcagatcagcacaggatttatgaccctggcccctgtgaagcagaccctgaacttcgacctgctgaagctggccggcgacgtggagagcaatcccggccctatggagtccatccccgctaggctcaacgctgtgcaggagaaaattctggatctgtatgaggccgacagcaacgatctgaatgcccagatcgagcactggaaactcaccaggatggagtgcgtgctgttttataaggccaaggaactcggcatcacccatattggccaccaagtcgtgcctcccatggccgtgagcaaggccaaggcttgtcaagctatcgaactgcagctggccctggaagccctgaacaaaacacagtatagcacagatggatggaccctgcagcagacatccctggagatgtggagggccgaaccccagaaatattttaagaaacacggctatacaattacagtgcagtacgacaatgacaaaaataacacaatggattataccaactggaaggagatctatctgctgggcgagtgtgagtgcacaattgtggagggccaagtggactactatggcctgtattactggtgcgatggcgagaagatctactttgtcaaattttccaacgacgctaaacagtactgcgtgaccggcgtgtgggaagtccatgtgggcggccaagtgattgtgtgccctgccagcgtgagctccggaggcacaggcggttctaccgcccccatcatccacctgaagggagaccccaactccctgaaatgcctgagatacagagtcaaaacacataagagcctgtacgtgcaaatttcctccacctggcactggacctccaatgaatgcacaaataacaagctgggaatcgtcaccattacctacagcgatgagacccaaagacagcaattcctcaagaccgtgaagatccctaacaccgtccaggtcatccagggagtcatgagcctggcccctgtgaagcagaccctgaacttcgacctgctgaagctggccggcgacgtggagagcaatcccggccctatggaggaaatcagcgccaggctctccgctgtgcaagacaagattctggacatctacgaagctgataagaacgacctgacatcccagattgagcactggaagctgatcaggatggaatgcgccatcatgtatacagccaggcaaatgggcatctcccacctgtgtcaccaggtcgtgccttccctggtggcttccaagaccaaagcttttcaggtcatcgagctgcaaatggccctggaaaccctgaatgccagcccctataagaccgacgaatggacactccaacagaccagcctggaggtgtggctgtccgaacctcaaaaatgttttaaaaaaaagggcatcaccgtgacagtccagtatgataacgataaagccaacacaatggactatacaaactggagcgagatttatattattgaggaaaccacctgcacactggtcgctggcgaagtggactacgtcggactctactacattcatggaaatgaaaaaacatatttcaagtattttaaggaagatgctaaaaaatatagcaagacacaactctgggaagtccatgtcggcagcagggtgattgtgtgtcccacaagcatccccagcggaggaacaggaggcagcgtcagccctattgtgcacctcaaaggcgatcctaattccctgaagtgtctcaggtacagactgaagccctttaaggatctgtattgcaatatgtcctccacctggcactggacaagcgacgacaaaggcgataaagtgggcattgtgaccgtgacctacaccaccgagacacagaggcaactgttcctcaacaccgtgaaaatcccccccaccgtccaaatcagcacaggcgtgatgtccttagcccctgtgaagcagaccctgaacttcgacctgctgaagctggccggcgacgtggagagcaatcccggccctgatcctcaggaaaggcctaggaaactgccccaactgtgtaccgaactgcagacaaccatccatgatattattctggagtgcgtgtattgtaaacagcagctgctgagaagagaagtgtacgacttcgcctttagggacctgtgcatcgtgtacagagatggcaatccctacgctgtctgtgacaaatgcctgaaattctattccaaaattagcgaatacagacactactgctacagcctgtacggaaccaccctcgagcagcagtataacaaacccctctgtgacctgctgatcagatgcattaattgccaaaaacccctctgccctgaggaaaaacagagacacctggataagaagcaaaggttccacaatattaggggaagatggaccggcaggtgcatgtcctgttgcaggtcctccgcccctgtgaagcagaccctgaacttcgacctgctgaagctggccggcgacgtggagagcaatcccggccctgaccctacaagaaggccctacaaactccctgatctgtgcacagagctgaacacctccctgcaagacattgaaatcacctgtgtctactgcaaaaccgtcctggaactcacagaggtcttcgagttcgctttcaaagacctcttcgtggtgtacagggattccattcctcacgccgcctgccataaatgtatcgacttttactccagaatcagggaactgaggcactattccgacagcgtgtacggagataccctggagaagctcaccaacaccggcctgtacaatctgctgatcaggtgtctgagatgtcagaagcccctgaatcccgccgagaaactgaggcacctgaatgagaagaggagatttcataacatcgctggccactacaggggccagtgccacagctgctgtaatagggccgcccctgtgaagcagaccctgaacttcgacctgctgaagctggccggcgacgtggagagcaatcccggccctaaccccgctgagaggcccagaaaactgcatgaactgagcagcgctctggagatcccttacgatgaactcaggctgaactgtgtgtactgtaagggacagctcaccgagaccgaagtcctggatttcgctttcaccgacctcacaattgtgtacagagatgacaccccccacggcgtctgtacaaaatgcctcagattctactccaaagtgtccgagtttagatggtataggtatagcgtgtatggaaccaccctggaaaagctcacaaacaaaggcatctgcgatctcctgattagatgcatcacctgccagaggcccctgtgtcccgaggagaagcaaagacatctcgacaagaagaagaggtttcataatattggcggaagatggacaggcaggtgcatcgcctgctggaggaggcctgcccctgtgaagcagaccctgaacttcgacctgctgaagctggccggcgacgtggagagcaatcccggccctgaccccaagcagagaccctataagctgcctgatctctgtacagaactgaatacctccctgcaggacgtcagcattgcttgcgtctattgcaaggccacactggaaagaaccgaagtgtatcaatttgccttcaaggacctctgtatcgtgtatagagattgcatcgcctatgccgcctgccacaagtgcattgatttctactccaggattagagaactgagatattattccaattccgtgtatggagagacactcgagaagatcacaaacaccgagctctacaacctcctgattagatgcctcaggtgccagaaacccctgaaccccgccgagaagaggaggcatctgaaggacaagagaagattccatagcatcgccggacagtatagaggacaatgcaacacctgttgcgaccaagctgcccctgtgaagcagaccctgaacttcgacctgctgaagctggccggcgacgtggagagcaatcccggccctgatcctgccacaaggcctaggacactgcatgagctctgcgaggtcctggaagagagcgtccacgagattaggctccagtgtgtgcagtgtaagaaggagctgcagagaagggaggtgtacaagttcctgttcaccgacctgaggattgtgtacagagacaataacccttacggcgtgtgtatcatgtgtctgaggtttctgtccaagatctccgagtataggcactatcagtacagcctctatggcaaaaccctcgaggaaagggtgaaaaaacctctgtccgaaatcaccatcaggtgcattatttgtcagacccccctctgccccgaagagaaggagaggcacgtcaatgctaacaaaagattccataacattatgggaaggtggaccggcagatgcagcgaatgttggagacccagggcccctgtgaagcagaccctgaacttcgacctgctgaagctggccggcgacgtggagagcaatcccggccctgacgccgaggaaaagcccagaacactgcacgatctctgccaggctctggaaacctccgtgcatgaaattgagctcaagtgtgtggagtgtaaaaagacactccagaggtccgaggtgtacgactttgtctttgccgatctgagaattgtgtacagagacggaaatcctttcgctgtctgcaaagtctgcctcagactgctgtccaagattagcgagtatagacactataattactccctgtacggcgacacactcgagcagaccctcaagaaatgcctcaacgagattctgattaggtgtatcatctgtcagaggcccctctgtcctcaggaaaaaaaaagacatgtggacctgaacaagagattccacaacattagcggcaggtggacaggcagatgcgctgtgtgttggaggcctagatga

SEQ ID NO: 132 - protein, 2322 aa, artificial
  synthetic polypeptide
MAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTDKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLGGGGGKQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTDKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLDLGGGGGTKANILYKFKEAYGISFMELVRPFKSDKTSCTDWCITGYGISPSVAESLKVLIKQHSLYTHLQCLTCDRGIIILLLIRFRCSKNRLTVAKLMSNLLSIPETCMVIEPPKLRSQTCALYWFRTAMSNISDVQGTTPEWIDRLTVLQHSFNDNIFDLSEMVQWAYDNELTDDSDIAYYYAQLADSNSNAAAFLKSNSQAKIVKDCGIMCRHYKKAEKRKMSIGQWIQSRCEKTNDGGNWRPIVQLLRYQNIEFTAFLGAFKKFLKGIPKKSCMLICGPANTDKSYFGMSLIQFLKGCVISCVNSKSHFWLQPLSDAKIGMIDDVTPISWTYIDDYMRNALDGNEISIDVKHRALVQLKCPPLLLTSNTNAGTDSRWPYLHSRLTVFEFKNPFPFDENGNPVYAINDENWKSFFSRTWCKLDLGGGGGRAHYNIVTFCCKCDSTLRLCVQSTHVDIRTLEDLLMGTLGIVCPICSQKPTLHEYMLDLQPETTDLYGYQQLGGGGGRHTMLCMCCKCEARIKLVVESSADDLRAFQQLFLNTLSFVCPWCASQQTLQDIVLHLEPQNEIPVDLLGHQQLSDSEEENDEIDGGGGGMKMQTPKESLSERLSALQDKILDHYENDSKDINSQISYWQLIRLENAILFTAREHGITKLNHQVVPPINISKSKAHKAIELQMALKGLAQSKYNNEEWTLQDTCEELWNTEPSQCFAKGGKTVHVYFDGNKDNCMNYVVWDSIYYITETGIWDKTAACVSYWGVYYIKDGDTTYYVQFKSECEKYGNSNTWEVQYGGNVIDCNDSMCSGGTGGSTTPIIHLKGDKNSLKCLRYRLRKYADHYSEISSTWHWTGCNKNTGILTVTYNSEVQRNTFLDVVTIPNSVQISVGYMTIGGGGGMESIPARLNAVQEKILDLYEADSNDLNAQIEHWKLTRMECVLFYKAKELGITHIGHQVVPPMAVSKAKACQAIELQLALEALNKTQYSTDGWTLQQTSLEMWRAEPQKYFAKHGYTITVQYDNDKNNTMDYTNWKEIYLLGECECTIVEGQVDYYGLYYWCDGEKIYFVKFSNDAKQYCVTGVWEVHVGGQVIVCPASVSSGGTGGSTAPIIHLKGDPNSLKCLRYRVKTHKSLYVQISSTWHWTSNECTNNKLGIVTITYSDETQRQQFLKTVKIPNTVQVIQGVMSLGGGGGMEEISARLSAVQDKILDIYEADKNDLTSQIEHWKLIRMECAIMYTARQMGISHLCHQVVPSLVASKTKAFQVIELQMALETLNASPYKTDEWTLQQTSLEVWLSEPQKCFAKKGITVTVQYDNDKANTMDYTNWSEIYIIEETTCTLVAGEVDYVGLYYIHGNEKTYFKYFKEDAKKYSKTQLWEVHVGSRVIVCPTSIPSGGTGGSVSPIVHLKGDPNSLKCLRYRLKPFKDLYCNMSSTWHWTSDDKGDKVGIVTVTYTTETQRQLFLNTVKIPPTVQISTGVMSL

SEQ ID NO: 133 - protein, 2186 aa, artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIAKHGYTVEVQFDGDICNTMHYTNWTHIYICEEASVTVVEGQVDYYGLYYVHEGIRTYFVQFKDDAEKYSKNKVWEVHAGGQVILCPTSVFSGGTGGSTTPIVHLKGDANTLKCLRYRFKKHCTLYTAVSSTWHWTGHNVKHKSAIVTLTYDSEWQRDQFLSQVKIPKTITVSTGFMSIGGGGGMQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFAKGGQTVQVYFDGNKDNCMTYVAWDSVYYMTDAGTWDKTATCVSHRGLYYVKEGYNTFYIEFKSECEKYGNTGTWEVHFGNNVIDCNDSMCSGGTGGSTTPIIHLKGDRNSLKCLRYRLRKHSDHYRDISSTWHWTGAGNEKTGILTVTYHSETQRTKFLNTVAIPDSVQILVGYMTMGGGGGMETLSQRLNVCQDKILEHYENDSKRLCDHIDYWKHIRLECVLMYKAREMGIHSINHQVVPALSVSKAKALQAIELQMMLETLNNTEYKNEDWTMQQTSLELYLTAPTGCLAKHGYTVEVQFDGDVHNTMHYTNWKFIYLCIDGQCTVVEGQVNCKGIYYVHEGHITYFVNFTEEAKKYGTGKKWEVHAGGQVIVFPESVFSGGTGGSTTPIIHLKGDANILKCLRYRLSKYKQLYEQVSSTWHWTCTDGKHKNAIVTLTYISTSQRDDFLNTVKIPNTVSVSTGYMTIGGGGGMEEISARLNAVQEKILDLYEADKTDLPSQIEHWKLIRMECALLYTAKQMGFSHLCHQVVPSLLASKTKAFQVIELQMALETLSKSQYSTSQWTLQQTSLEVWLCEPPKCFAKQGETVTVQYDNDKKNTMDYTNWGEIYIIEEDTCTMVTGKVDYIGMYYIHNCEKVYFKYFKEDAAKYSKTQMWEVHVGGQVIVCPTSISSGGTGGSVAPIVHLKGESNSLKCLRYRLKPYKELYSSMSSTWHWTSDNKNSKNGIVTVTFVTEQQQQMFLGTVKIPPTVQISTGFMTLGGGGGDPQERPRKLPQLCTELQTTIHDIILECVYCKQQLLRREVYDFARRDLCIVYRDGNPYAVCDKCLKFYSKISEYRHYCYSLYGTTLEQQYNKPLCDLLIRRINCQKPLCPEEKQRHLDKKQRFHNIRGRWTGRCMSCCRSSGGGGGDPTRRPYKLPDLCTELNTSLQDIEITCVYCKTVLELTEVFEFARKDLFVVYRDSIPHAACHKCIDFYSRIRELRHYSDSVYGDTLEKLTNTGLYNLLIRRLRCQKPLNPAEKLRHLNEKRRFHNIAGHYRGQCHSCCNRAGGGGGNPAERPRKLHELSSALEIPYDELRLNCVYCKGQLTETEVLDFARTDLTIVYRDDTPHGVCTKCLRFYSKVSEFRWYRYSVYGTTLEKLTNKGICDLLIRRITCQRPLCPEEKQRHLDKKKRFHNIGGRWTGRCIACWRRPGGGGGDTEEKPRTLHDLCQALETTIHNIELQCVECKKPLQRSEVYDFARADLTVVYREGNPFGICKLCLRFLSKISEYRHYNYSVYGNTLEQTVKKPLNEILIRRIICQRPLCPQEKKRHVDLNKRFHNISGRWAGRCAACWRSRGGGGGDPKQRPYKLPDLCTELNTSLQDVSIACVYCKATLERTEVYQFARKDLCIVYRDCIAYAACHKCIDFYSRIRELRYYSNSVYGETLEKITNTELYNLLIRRLRCQKPLNPAEKRRHLKDKRRFHSIAGQYRGQCNTCCDQAGGGGGDPATRPRTLHELCEVLEESVHEIRLQCVQCKKELQRREVYKFLRTDLRIVYRDNNPYGVCIMCLRFLSKISEYRHYQYSLYGKTLEERVKKPLSEITIRRIICQTPLCPEEKERHVNANKRFHNIMGRWTGRCSECWRPRGGGGGDAEEKPRTLHDLCQALETSVHEIELKCVECKKTLQRSEVYDFVRADLRIVYRDGNPFAVCKVCLRLLSKISEYRHYNYSLYGDTLEQTLKKCLNEILIRRIICQRPLCPQEKKRHVDLNKRFHNISGRWTGRCAVCWRPR

SEQ ID NO: 134 - protein, 2222 aa, artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIAKHGYTVEVQFDGDICNTMHYTNWTHIYICEEASVTVVEGQVDYYGLYYVHEGIRTYFVQFKDDAEKYSKNKVWEVHAGGQVILCPTSVFSGGTGGSTTPIVHLKGDANTLKCLRYRFKKHCTLYTAVSSTWHWTGHNVKHKSAIVTLTYDSEWQRDQFLSQVKIPKTITVSTGFMSIGGGGGMQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFAKGGQTVQVYFDGNKDNCMTYVAWDSVYYMTDAGTWDKTATCVSHRGLYYVKEGYNTFYIEFKSECEKYGNTGTWEVHFGNNVIDCNDSMCSGGTGGSTTPIIHLKGDRNSLKCLRYRLRKHSDHYRDISSTWHWTGAGNEKTGILTVTYHSETQRTKFLNTVAIPDSVQILVGYMTMGGGGGMETLSQRLNVCQDKILEHYENDSKRLCDHIDYWKHIRLECVLMYKAREMGIHSINHQVVPALSVSKAKALQAIELQMMLETLNNTEYKNEDWTMQQTSLELYLTAPTGCLAKHGYTVEVQFDGDVHNTMHYTNWKFIYLCIDGQCTVVEGQVNCKGIYYVHEGHITYFVNFTEEAKKYGTGKKWEVHAGGQVIVFPESVFSGGTGGSTTPIIHLKGDANILKCLRYRLSKYKQLYEQVSSTWHWTCTDGKHKNAIVTLTYISTSQRDDFLNTVKIPNTVSVSTGYMTIGGGGGMEEISARLNAVQEKILDLYEADKTDLPSQIEHWKLIRMECALLYTAKQMGFSHLCHQVVPSLLASKTKAFQVIELQMALETLSKSQYSTSQWTLQQTSLEVWLCEPPKCFAKQGETVTVQYDNDKKNTMDYTNWGEIYIIEEDTCTMVTGKVDYIGMYYIHNCEKVYFKYFKEDAAKYSKTQMWEVHVGGQVIVCPTSISSGGTGGSVAPIVHLKGESNSLKCLRYRLKPYKELYSSMSSTWHWTSDNKNSKNGIVTVTFVTEQQQQMFLGTVKIPPTVQISTGFMTLGGGGGMKMQTPKESLSERLSALQDKILDHYENDSKDINSQISYWQLIRLENAILFTAREHGITKLNHQVVPPINISKSKAHKAIELQMALKGLAQSKYNNEEWTLQDTCEELWNTEPSQCFAKGGKTVHVYFDGNKDNCMNYVVWDSIYYITETGIWDKTAACVSYWGVYYIKDGDTTYYVQFKSECEKYGNSNTWEVQYGGNVIDCNDSMCSGGTGGSTTPIIHLKGDKNSLKCLRYRLRKYADHYSEISSTWHWTGCNKNTGILTVTYNSEVQRNTFLDVVTIPNSVQISVGYMTIGGGGGMESIPARLNAVQEKILDLYEADSNDLNAQIEHWKLTRMECVLFYKAKELGITHIGHQVVPPMAVSKAKACQAIELQLALEALNKTQYSTDGWTLQQTSLEMWRAEPQKYFAKHGYTITVQYDNDKNNTMDYTNWKEIYLLGECECTIVEGQVDYYGLYYWCDGEKIYFVKFSNDAKQYCVTGVWEVHVGGQVIVCPASVSSGGTGGSTAPIIHLKGDPNSLKCLRYRVKTHKSLYVQISSTWHWTSNECTNNKLGIVTITYSDETQRQQFLKTVKIPNTVQVIQGVMSLGGGGGMEEISARLSAVQDKILDIYEADKNDLTSQIEHWKLIRMECAIMYTARQMGISHLCHQVVPSLVASKTKAFQVIELQMALETLNASPYKTDEWTLQQTSLEVWLSEPQKCFAKKGITVTVQYDNDKANTMDYTNWSEIYIIEETTCTLVAGEVDYVGLYYIHGNEKTYFKYFKEDAKKYSKTQLWEVHVGSRVIVCPTSIPSGGTGGSVSPIVHLKGDPNSLKCLRYRLKPFKDLYCNMSSTWHWTSDDKGDKVGIVTVTYTTETQRQLFLNTVKIPPTVQISTGVMSLGGGGGRAHYNIVTFCCKCDSTLRLCVQSTHVDIRTLEDLLMGTLGIVCPICSQKPTLHEYMLDLQPETTDLYGYQQLGGGGGRHTMLCMCCKCEARIKLVVESSADDLRAFQQLFLNTLSFVCPWCASQQTLQDIVLHLEPQNEIPVDLLGHQQLSDSEEENDEID

SEQ ID NO: 135 - protein, 1860 aa, artificial
  synthetic polypeptide
MAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTDKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLGGGGGDPQERPRKLPQLCTELQTTIHDIILECVYCKQQLLRREVYDFARRDLCIVYRDGNPYAVCDKCLKFYSKISEYRHYCYSLYGTTLEQQYNKPLCDLLIRRINCQKPLCPEEKQRHLDKKQRFHNIRGRWTGRCMSCCRSSGGGGGDPTRRPYKLPDLCTELNTSLQDIEITCVYCKTVLELTEVFEFARKDLFVVYRDSIPHAACHKCIDFYSRIRELRHYSDSVYGDTLEKLTNTGLYNLLIRRLRCQKPLNPAEKLRHLNEKRRFHNIAGHYRGQCHSCCNRAGGGGGNPAERPRKLHELSSALEIPYDELRLNCVYCKGQLTETEVLDFARTDLTIVYRDDTPHGVCTKCLRFYSKVSEFRWYRYSVYGTTLEKLTNKGICDLLIRRITCQRPLCPEEKQRHLDKKKRFHNIGGRWTGRCIACWRRPGGGGGDTEEKPRTLHDLCQALETTIHNIELQCVECKKPLQRSEVYDFARADLTVVYREGNPFGICKLCLRFLSKISEYRHYNYSVYGNTLEQTVKKPLNEILIRRIICQRPLCPQEKKRHVDLNKRFHNISGRWAGRCAACWRSRGGGGGDPKQRPYKLPDLCTELNTSLQDVSIACVYCKATLERTEVYQFARKDLCIVYRDCIAYAACHKCIDFYSRIRELRYYSNSVYGETLEKITNTELYNLLIRRLRCQKPLNPAEKRRHLKDKRRFHSIAGQYRGQCNTCCDQAGGGGGDPATRPRTLHELCEVLEESVHEIRLQCVQCKKELQRREVYKFLRTDLRIVYRDNNPYGVCIMCLRFLSKISEYRHYQYSLYGKTLEERVKKPLSEITIRRIICQTPLCPEEKERHVNANKRFHNIMGRWTGRCSECWRPRGGGGGDAEEKPRTLHDLCQALETSVHEIELKCVECKKTLQRSEVYDFVRADLRIVYRDGNPFAVCKVCLRLLSKISEYRHYNYSLYGDTLEQTLKKCLNEILIRRIICQRPLCPQEKKRHVDLNKRFHNISGRWTGRCAVCWRPRGGGGGKQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTDKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLD

SEQ ID NO: 136 - protein, 1861 aa, artificial
  synthetic polypeptide
MAKAAMLAKFKELYGVSFSELVRPFKSNKSTCCDWCIAAFGLTPSIADSIKTLLQQYCLYLHIQSLACSWGMVVLLLVRYKCGKNRETIEKLLSKLLCVSPMCMMIEPPKLRSTAAALYWYKTGISNISEVYGDTPEWIQRQTVLQHSFNDCTFELSQMVQWAYDNDIVDDSEIAYKYAQLADTNSNASAFLKSNSQAKIVKDCATMCRHYKRAEKKQMSMSQWIKYRCDRVDDGGDWKQIVMFLRYQGVEFMSFLTALKRFLQGIPKKNCILLYGAANTDKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDENGNPVYELNDKNWKSFFSRTWSRLSLGGGGGKQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTDKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLDLGGGGGDPQERPRKLPQLCTELQTTIHDIILECVYCKQQLLRREVYDFARRDLCIVYRDGNPYAVCDKCLKFYSKISEYRHYCYSLYGTTLEQQYNKPLCDLLIRRINCQKPLCPEEKQRHLDKKQRFHNIRGRWTGRCMSCCRSSGGGGGDPTRRPYKLPDLCTELNTSLQDIEITCVYCKTVLELTEVFEFARKDLFVVYRDSIPHAACHKCIDFYSRIRELRHYSDSVYGDTLEKLTNTGLYNLLIRRLRCQKPLNPAEKLRHLNEKRRFHNIAGHYRGQCHSCCNRAGGGGGDTEEKPRTLHDLCQALETTIHNIELQCVECKKPLQRSEVYDFARADLTVVYREGNPFGICKLCLRFLSKISEYRHYNYSVYGNTLEQTVKKPLNEILIRRIICQRPLCPQEKKRHVDLNKRFHNISGRWAGRCAACWRSRGGGGGDPKQRPYKLPDLCTELNTSLQDVSIACVYCKATLERTEVYQFARKDLCIVYRDCIAYAACHKCIDFYSRIRELRYYSNSVYGETLEKITNTELYNLLIRRLRCQKPLNPAEKRRHLKDKRRFHSIAGQYRGQCNTCCDQAGGGGGDPATRPRTLHELCEVLEESVHEIRLQCVQCKKELQRREVYKFLRTDLRIVYRDNNPYGVCIMCLRFLSKISEYRHYQYSLYGKTLEERVKKPLSEITIRRIICQTPLCPEEKERHVNANKRFHNIMGRWTGRCSECWRPRGGGGGDAEEKPRTLHDLCQALETSVHEIELKCVECKKTLQRSEVYDFVRADLRIVYRDGNPFAVCKVCLRLLSKISEYRHYNYSLYGDTLEQTLKKCLNEILIRRIICQRPLCPQEKKRHVDLNKRFHNISGRWTGRCAVCWRPRGGGGGNPAERPRKLHELSSALEIPYDELRLNCVYCKGQLTETEVLDFARTDLTIVYRDDTPHGVCTKCLRFYSKVSEFRWYRYSVYGTTLEKLTNKGICDLLIRRITCQRPLCPEEKQRHLDKKKRFHNIGGRWTGRCIACWRRP

SEQ ID NO: 137 - DNA, 6969 bp, artificial
  synthetic polynucleotide
atggccaaagctgccatgctggctaaatttaaggaactgtacggcgtgagcttctccgagctggtgaggcctttcaagtccaataagtccacatgctgcgactggtgcattgccgccttcggcctgaccccttccatcgctgacagcatcaagaccctcctgcaacagtactgcctgtacctccacatccaaagcctggcctgcagctggggaatggtggtgctcctgctggtcaggtataaatgcggaaaaaatagggagaccatcgaaaagctgctgtccaaactgctctgcgtgagccctatgtgtatgatgatcgagccccctaaactcagaagcaccgctgctgccctgtactggtacaaaaccggcatttccaatattagcgaagtgtacggagacacccctgaatggattcagaggcagaccgtgctccagcacagcttcaacgactgcaccttcgagctcagccaaatggtccagtgggcttatgacaacgacatcgtggacgattccgaaattgcctacaagtacgcccaactcgccgacaccaatagcaatgcctccgctttcctcaagtccaactcccaggctaaaatcgtcaaggactgcgccacaatgtgcaggcattacaagagggccgagaagaagcagatgtccatgagccagtggatcaagtacagatgcgatagggtggacgatggaggcgactggaagcagatcgtgatgttcctcagataccagggcgtggagttcatgagcttcctcaccgctctcaagaggttcctgcagggaattcccaaaaagaattgcattctcctgtatggcgccgccaataccgacaaaagcctcttcggaatgtccctgatgaagttcctgcaaggctccgtcatctgcttcgtcaacagcaagagccacttctggctgcagcccctggccgacgccaaaatcggtatgttagacgacgctaccgtgccctgctggaattacattgatgataacctcaggaatgctctggatggaaacctcgtcagcatggatgtgaagcatagacctctggtgcaactgaaatgtcctcccctgctgatcacaagcaatattaacgccggcacagactccaggtggccttacctgcacaacaggctggtcgtgtttacattccccaacgagtttccctttgatgaaaacggcaaccctgtgtacgagctgaacgacaagaactggaagagctttttcagcaggacctggagcagactcagcctcggaggcggaggaggaaagcaaggagctatgctggccgtgttcaaagacacctacggcctctcctttacagacctcgtcagaaacttcaaatccgacaagaccacatgcacagactgggtgaccgctatcttcggagtcaatcccacaatcgctgagggctttaaaaccctcattcaacccttcatcctgtacgctcacatccagtgcctcgattgcaagtggggagtcctgatcctcgctctgctcaggtacaagtgcggaaagagcagactcacagtcgccaagggcctctccaccctgctgcacgtgcctgagacatgtatgttaatccaaccccctaaactgagatcctccgtggctgccctctactggtacaggacaggaatcagcaatatctccgaggtcatgggcgacacacctgaatggattcaaagactcacaattatccagcacggaatcgatgactccaacttcgatctctccgaaatggtgcagtgggcctttgacaatgagctcaccgacgagtccgacatggccttcgaatatgccctgctcgccgattccaattccaacgctgccgccttcctgaagagcaactgtcaagctaaatacctgaaggactgcgctaccatgtgcaagcattataggagggctcaaaaaaggcagatgaacatgtcccagtggattaggtttaggtgctccaagattgatgaaggcggcgactggaggcccattgtgcagttcctcaggtatcaacagattgagtttatcaccttcctgggcgctctgaagagctttctcaagggcacacctaaaaaaaattgcctcgtcttttgcggccccgctaacaccgataaatcctactttggaatgtccttcatccacttcatccaaggcgccgtcatcagcttcgtgaactccacctcccacttttggctcgaacccctgaccgacaccaaagtcgccatgctcgatgacgccaccaccacctgctggacctacttcgatacctacatgaggaatgctctcgacggcaaccccattagcattgacagaaaacacaagcccctgattcagctgaagtgccctcctatcctcctgaccacaaacattcaccccgctaaggataacagatggccctacctcgagtccagaattacagtgttcgaattccctaacgccttccccttcgacaagaacggaaatcctgtgtatgagattaacgataagaattggaaatgcttcttcgagagaacctggagcaggctggatctgggcggaggaggcggcacaaaggctaacatcctctacaagttcaaggaggcttacggcatcagcttcatggagctcgtcaggcctttcaaatccgataagacaagctgtacagactggtgcatcaccggctatggaatcagcccctccgtggctgagtccctcaaagtgctgatcaaacagcatagcctctacacacacctgcagtgcctcacatgtgacaggggcatcatcattctgctgctgatcaggttcagatgctccaagaataggctgacagtggccaagctgatgtccaatctgctgtccattcccgaaacctgcatggtcatcgaaccccccaagctcaggtcccagacctgcgccctgtattggttcagaaccgctatgtccaatatttccgatgtgcagggcaccacacccgagtggattgacaggctgacagtcctgcagcactccttcaatgataacatcttcgacctctccgagatggtgcaatgggcctacgataatgagctgacagatgactccgatattgcctattattacgcccagctggccgattccaactccaatgctgctgcttttctgaaaagcaatagccaagccaagatcgtcaaagattgcggaattatgtgcagacattataaaaaagccgaaaaaagaaagatgagcatcggccagtggattcaaagcagatgtgaaaagaccaacgatggcggcaactggaggcctatcgtgcagctgctgaggtatcaaaacattgagttcaccgcttttctgggcgccttcaagaagttcctcaaaggaatccctaagaagagctgtatgctgatctgtggacctgccaacaccgataagagctatttcggaatgagcctgattcagttcctgaagggctgcgtgatcagctgcgtcaactccaaatcccatttctggctccaacccctgtccgatgctaagatcggcatgattgatgacgtcacccccatctcctggacatatatcgacgactacatgagaaacgccctcgatggcaacgagatcagcatcgatgtcaagcacagggccctggtccagctcaaatgccctcccctgctcctcacatccaataccaatgctggcacagacagcaggtggccttacctccattccaggctgaccgtgttcgagttcaagaaccccttcccttttgacgaaaacggaaaccccgtctacgctattaacgatgagaactggaaatccttcttttccagaacctggtgtaaactggacctgggcggcggcggcggaagggcccattacaacatcgtgaccttctgttgcaagtgtgactccaccctcagactgtgcgtccaatccacccatgtcgacattaggaccctcgaagacctgctcatgggcaccctgggcattgtctgccccatttgttcccaaaagcctaccctccatgagtatatgctggatctgcagcctgaaaccaccgatctctacggctatcagcaactcggaggaggcggcggaaggcacaccatgctgtgcatgtgctgcaaatgtgaggccaggattaagctggtggtggaaagcagcgctgatgacctcagggctttccaacagctgttcctgaacacactctccttcgtctgtccctggtgtgcctcccagcaaaccctccaagatattgtgctgcacctggagcctcagaatgagattcctgtggatctgctgggacatcaacagctgtccgattccgaggaagaaaatgacgagatcgatggcggaggaggcggaatgaaaatgcagacacccaaggagagcctgtccgagagactgagcgccctgcaagacaagatcctggatcactacgagaatgacagcaaggacattaactcccagatttcctactggcagctcatcagactcgaaaatgctatcctcttcacagctagagagcacggaattaccaaactgaaccaccaagtcgtcccccccattaatatctccaaatccaaagctcacaaagccatcgaactgcaaatggccctcaagggactcgcccaatccaagtacaataacgaggagtggacactccaagacacctgtgaagagctgtggaacacagaacctagccagtgcttcgctaagggcggcaagaccgtgcacgtctattttgatggcaataaagacaattgtatgaactacgtcgtgtgggactccatttattacatcaccgagacaggcatttgggataagaccgccgcctgtgtcagctattggggagtctactatatcaaggatggcgacacaacatattatgtgcaatttaaaagcgagtgcgagaagtatggcaactccaatacatgggaggtgcagtacggcggaaacgtcattgactgcaacgattccatgtgctccggaggcaccggcggaagcacaacacctattattcacctcaagggagataaaaacagcctcaagtgtctgaggtataggctcaggaagtatgccgaccattatagcgagatttccagcacatggcactggacaggctgtaacaagaacaccggcattctcacagtcacctacaactccgaagtccagaggaatacattcctggacgtcgtcacaatccctaactccgtccagatcagcgtcggctacatgaccatcggcggaggcggcggaatggagtccatccccgctaggctgaacgctgtccaagaaaagattctcgatctctacgaagccgacagcaatgacctcaacgcccagatcgaacattggaagctgaccaggatggagtgcgtcctgttttacaaggccaaggagctcggaatcacacacatcggccaccaggtggtgccccccatggccgtgtccaaggccaaagcttgtcaagccattgagctccagctggccctggaggctctgaataaaacacaatacagcaccgatggctggaccctccaacagacctccctcgagatgtggagggccgagccccagaagtatttcgccaagcacggctacaccatcaccgtccaatacgataatgacaaaaataacacaatggactacacaaattggaaggaaatctacctcctcggcgagtgcgaatgcaccatcgtcgaaggacaggtggactactacggcctctattattggtgcgacggcgaaaagatctatttcgtgaaattcagcaacgatgccaagcagtactgcgtcaccggagtgtgggaagtgcacgtcggcggacaggtgatcgtgtgtcccgctagcgtgtccagcggcggaaccggcggctccaccgctcccatcatccatctgaaaggcgaccccaactccctgaaatgtctcaggtacagggtcaagacacacaagtccctctacgtgcaaatcagctccacctggcactggacctccaacgagtgcaccaataacaaactgggcattgtgaccatcacatactccgacgagacacagagacagcagttcctcaaaaccgtcaagattcccaacacagtgcaggtgattcagggagtcatgtccctcggaggaggcggcggaatggaagaaattagcgctagactcagcgctgtgcaggataagattctcgacatttatgaggctgacaaaaacgacctgacctcccagattgagcactggaaactgatcagaatggagtgtgccattatgtacaccgccaggcaaatgggcatttcccacctctgccatcaggtcgtgcccagcctggtggctagcaagaccaaggccttccaagtgatcgagctccaaatggccctggaaacactcaacgcctccccttacaagaccgacgaatggacactccagcaaacctccctggaggtgtggctcagcgagcctcagaagtgcttcgccaagaagggcatcaccgtcaccgtccagtacgacaacgataaggccaacacaatggattacacaaactggagcgaaatctatattatcgaggagaccacctgcaccctggtcgccggagaagtggactatgtgggcctgtactatatccacggcaatgaaaagacatatttcaaatacttcaaggaagatgccaagaaatatagcaagacccagctctgggaagtgcatgtgggctccagagtgatcgtctgtcccacctccattcccagcggcggaaccggaggaagcgtgagccccatcgtccatctcaagggcgatcccaatagcctgaagtgcctcaggtataggctgaaacctttcaaagacctgtattgcaatatgtcctccacctggcattggacctccgacgacaagggcgacaaggtcggcatcgtcaccgtgacctacaccacagaaacccaaaggcaactgtttctcaacaccgtcaaaatccctcccaccgtccaaatcagcaccggcgtcatgagcctgtga

SEQ ID NO: 138 - DNA, 6561 bp, artificial
  synthetic polynucleotide
atggagaccctgtgtcagagactgaacgtgtgtcaggacaaaatcctgacccattatgagaatgacagcaccgatctgagggatcacatcgattactggaagcacatgagactggagtgtgccatctactataaggccagggagatgggctttaagcatatcaatcaccaagtggtccctaccctcgccgtgtccaagaacaaagccctccaggctatcgaactgcagctgaccctcgaaacaatctataacagccagtattccaacgagaaatggacactccaggacgtgagcctcgaagtgtacctgaccgcccccacaggctgtattgccaaacatggatacaccgtcgaagtccagttcgatggcgacatctgtaataccatgcactacacaaactggacccatatctacatttgtgaggaggccagcgtgaccgtggtcgagggacaggtcgactactacggactctactacgtgcatgagggcatcaggacctatttcgtgcaatttaaggatgatgctgagaagtattccaagaataaggtctgggaagtccacgccggcggacaggtgatcctctgtcctacaagcgtgttctccggaggaacaggaggctccacaacccctatcgtgcacctcaagggcgacgctaacacactgaaatgcctcagatacagatttaaaaaacattgtaccctctataccgctgtgagctccacctggcactggaccggccataacgtgaaacataagagcgccatcgtcacactcacctatgactccgagtggcaaagggaccagtttctcagccaagtcaaaatccccaagacaatcaccgtctccaccggattcatgagcatcggcggcggcggaggaatgcagacccccaaggagacactcagcgagaggctgtcctgtgtgcaggataagattatcgatcactatgaaaatgatagcaaagacattgatagccaaattcagtattggcagctgatcaggtgggagaacgccatcttcttcgctgccagggaacacggcattcaaacactgaaccatcaggtggtccctgcttataatatcagcaaatccaaagcccacaaggccattgagctccaaatggctctccagggactggcccagtccgcttacaagaccgaggactggaccctgcaggatacatgcgaggaactgtggaacaccgagcccacccattgctttgccaagggaggccagacagtccaggtgtacttcgatggcaacaaagacaattgcatgacctacgtcgcctgggactccgtgtactatatgaccgatgccggaacctgggataagaccgccacatgtgtgagccacagaggcctgtactacgtcaaggagggctataacaccttctacatcgagttcaagtccgagtgtgagaagtacggcaacaccggcacctgggaagtgcactttggcaacaacgtgatcgactgcaacgactccatgtgcagcggaggaacaggcggctccaccacccctatcattcacctcaagggcgataggaactccctgaagtgtctcaggtacaggctgagaaaacactccgatcactacagagacattagcagcacctggcactggaccggcgctggcaacgagaaaacaggcattctgaccgtgacatatcattccgagacacagaggaccaagtttctgaataccgtggccattcccgactccgtgcagatcctggtgggatatatgacaatgggcggaggaggcggaatggaaaccctgagccagagactgaatgtgtgccaagacaagattctggaacactacgagaacgactccaagagactctgcgaccatatcgactactggaaacacatcaggctggaatgcgtgctcatgtataaagccagagagatgggcattcacagcattaaccaccaagtcgtccccgctctgtccgtgtccaaggccaaagctctgcaagccatcgagctgcaaatgatgctggagacactcaataacacagaatacaagaacgaggattggaccatgcagcagaccagcctggagctgtacctcacagcccccaccggctgtctggccaagcatggctacaccgtcgaggtccagtttgacggagacgtccacaacaccatgcattacaccaattggaaattcatctacctctgcattgatggccaatgcaccgtggtcgaaggccaggtgaattgtaagggcatctactatgtccatgagggacatatcacatactttgtcaattttacagaggaggctaagaaatatggcacaggcaagaagtgggaggttcatgctggaggacaggtcattgtgttccctgagtccgtgttcagcggcggcacaggcggctccaccacacccatcatccacctcaagggcgacgccaatatcctcaagtgtctgaggtacagactgtccaaatacaagcagctgtacgagcaggtgagctccacctggcattggacatgcacagacggaaagcacaagaatgccatcgtcaccctcacatacattagcacctcccaaagggatgatttcctcaacaccgtcaagatccccaacacagtgtccgtctccaccggatacatgaccattggaggcggaggaggcatggaggagatcagcgctagactgaacgccgtccaggagaagattctggacctctacgaggccgacaaaacagacctccctagccaaatcgaacactggaaactgattagaatggagtgcgccctgctctacaccgctaaacaaatgggcttttcccacctgtgtcaccaagtggtcccttccctgctcgctagcaaaaccaaggcctttcaggtgatcgagctgcagatggccctggagacactgtccaaatcccaatactccacatcccagtggaccctgcaacaaaccagcctcgaagtctggctgtgtgagcctcccaagtgtttcgctaaacaaggcgagaccgtcaccgtgcagtatgacaatgataaaaaaaatacaatggattacacaaattggggcgaaatttacatcattgaggaggatacatgcacaatggtcaccggcaaagtcgactatatcggaatgtactatattcataattgcgagaaggtgtatttcaaatacttcaaggaggacgccgctaaatactccaagacccaaatgtgggaagtgcatgtgggcggacaggtcatcgtctgccctaccagcatctccagcggaggcacaggaggctccgtggctcccatcgtccatctgaagggcgaaagcaattccctcaaatgcctgagatacaggctcaagccctacaaagagctctactcctccatgagctccacatggcactggaccagcgacaacaaaaactccaaaaacggaatcgtcaccgtgacctttgtgaccgagcaacagcagcagatgttcctcggcaccgtgaaaattcctcccaccgtgcaaatttccaccggatttatgacactgggcggcggaggcggagatccccaggaaagacctaggaaactcccccagctgtgcaccgagctgcaaaccaccatccacgacatcattctggagtgcgtgtactgtaaacagcagctgctcaggagagaggtgtatgacttcgccaggagggacctgtgcatcgtgtacagggacggaaacccctacgctgtctgtgacaaatgtctcaaattctattccaaaatttccgaatataggcactactgctattccctgtacggcaccaccctggaacaacagtacaacaagcccctgtgcgatctgctcatcagaaggattaactgccaaaaacccctgtgtcctgaggagaagcagagacatctggacaaaaaacaaagatttcacaatattaggggcaggtggaccggaagatgcatgtcctgctgtagaagctccggcggaggaggaggagatcccacaagaaggccctataaactccccgacctctgcacagagctgaacaccagcctgcaggacatcgagatcacctgcgtctactgcaaaaccgtgctcgagctcaccgaggtgttcgagtttgctaggaaggatctcttcgtggtctacagggatagcatccctcatgccgcctgtcacaagtgcatcgacttttacagcaggattagggagctcagacactacagcgacagcgtgtatggcgatacactggagaagctgaccaacacaggactgtacaacctgctgatcagaagactcaggtgccaaaagcccctcaaccccgccgagaaactgaggcatctcaatgagaagagaaggtttcacaacattgctggacattacagaggccagtgtcacagctgttgcaatagggccggcggcggaggaggaaatcccgctgagaggcccaggaaactgcacgagctgtccagcgccctggagatcccctatgatgaactgaggctgaactgcgtgtactgcaaaggacagctgaccgaaaccgaggtgctcgactttgccaggaccgacctcacaattgtgtacagggatgatacacctcacggcgtctgcaccaagtgtctcagattctactccaaggtgtccgagttcaggtggtacaggtactccgtgtacggaaccaccctcgagaaactgaccaacaagggcatttgcgacctgctcatcaggagaattacctgtcagagacctctctgtcctgaggaaaagcagagacacctggataagaaaaagagattccacaacatcggcggcagatggaccggcagatgcattgcttgctggaggagacctggcggcggcggcggagatacagaggaaaagcccagaaccctgcacgacctctgtcaggctctcgaaacaacaatccacaatatcgagctgcaatgcgtggagtgcaaaaagcccctgcaaaggagcgaggtctacgattttgctagggccgatctgacagtggtgtatagggagggcaatcccttcggcatctgcaagctgtgtctgaggttcctgtccaagattagcgaatacaggcattataattactccgtctacggaaacaccctggagcagaccgtcaagaaacctctgaacgagatcctcatcagaaggattatctgtcaaaggcctctctgccctcaggaaaaaaagagacacgtggatctgaataagaggttccataacatttccggaaggtgggctggaagatgcgccgcttgttggaggtccagaggaggaggcggaggcgaccccaagcaaaggccctacaagctgcccgatctgtgcacagaactgaacacaagcctgcaagacgtgtccatcgcttgtgtctactgtaaggccaccctcgaaaggacagaagtctaccagtttgccaggaaagatctgtgcatcgtctacagggactgcatcgcttatgccgcctgccacaagtgtattgacttttattccagaatcagagaactcaggtattacagcaattccgtctatggcgaaaccctggagaagatcaccaacaccgagctgtataatctgctgattaggagactgaggtgtcagaagcctctgaaccccgccgaaaagaggagacatctgaaagataagaggagattccatagcatcgctggccagtatagaggccaatgtaacacctgttgcgaccaagctggaggcggaggaggagaccctgctacaagacccagaaccctgcacgagctctgtgaggtcctggaagaaagcgtgcacgaaatcaggctccagtgcgtccagtgtaagaaggagctccagagaagagaggtgtacaaatttctgagaaccgacctgaggattgtgtatagggataacaacccttacggagtctgtattatgtgtctgagatttctgtccaaaattagcgagtacagacattaccagtactccctgtatggcaagaccctggaagagagagtgaagaagcccctcagcgagatcacaattaggaggatcatttgccaaacccccctctgccccgaagagaaagagagacacgtcaacgccaacaaaaggttccacaatatcatgggaagatggaccggcaggtgttccgagtgctggaggcccagaggcggaggcggcggagacgctgaagagaagcctaggaccctccatgatctctgtcaagctctcgagacctccgtccacgaaatcgagctgaagtgtgtggagtgcaagaagacactccagaggagcgaggtgtacgacttcgtgagggccgacctcaggatcgtgtatagggacggcaaccctttcgctgtctgtaaagtctgtctcagactcctgtccaaaatctccgagtacaggcactataactatagcctctacggagacacactggagcaaaccctcaagaaatgtctcaatgagattctcatcagaaggatcatctgccaaaggcctctgtgcccccaggagaaaaaaagacatgtggacctgaacaagagattccataatattagcggcagatggaccggaaggtgcgctgtgtgctggagacctaggtga

SEQ ID NO: 139 - DNA, 6669 bp, artificial
  synthetic polynucleotide
atggagacactctgccaaagactgaatgtctgccaggacaaaatcctgacccattacgaaaacgatagcaccgacctgagggatcatattgactactggaaacacatgaggctcgaatgcgctatttactacaaggccagggagatgggatttaagcacatcaatcaccaagtcgtgcccaccctggctgtgagcaaaaacaaggctctgcaggccatcgagctccagctgacactggaaaccatctacaacagccagtatagcaatgaaaagtggacactccaggacgtcagcctggaggtctatctcaccgcccctaccggctgtatcgccaaacacggctacaccgtggaagtccaattcgatggcgacatttgtaataccatgcactacaccaactggacacatatctatatttgcgaagaggcttccgtgacagtggtggagggccaggtcgattactatggcctgtattacgtgcatgagggaatcagaacatatttcgtccaattcaaggacgacgctgaaaagtactccaaaaacaaggtctgggaggtccatgccggaggccaggtcatcctctgtcctacatccgtgtttagcggcggcaccggcggttctaccacacccattgtccacctgaagggagacgccaacaccctcaaatgtctcagatacagatttaagaagcattgcacactctacaccgccgtctccagcacctggcattggaccggccataacgtcaagcacaagtccgctatcgtgacactcacatatgactccgagtggcagagggaccagttcctctcccaagtgaagatccctaagacaattaccgtcagcaccggatttatgagcattggcggcggcggcggaatgcaaacacccaaagagaccctgagcgaaaggctgtcctgtgtccaggataagattatcgaccactatgaaaacgactccaaggacattgattcccagatccaatactggcagctgatcaggtgggaaaacgctattttcttcgccgccagagaacatggcatccagacactgaaccatcaggtggtgcctgcctacaatatcagcaagtccaaggcccacaaagccatcgagctgcaaatggccctccagggcctggcccagagcgcttacaaaaccgaggattggaccctgcaggacacctgtgaggaactgtggaacacagagcccacccactgctttgccaagggaggccagacagtccaggtgtattttgacggcaataaggataactgcatgacctacgtggcttgggacagcgtctactatatgacagacgccggcacctgggacaaaaccgccacctgtgtcagccacaggggcctgtactacgtgaaggagggctacaacacattctacatcgagtttaagagcgagtgtgaaaaatacggcaataccggcacctgggaggtgcacttcggcaacaatgtgatcgactgtaacgattccatgtgttccggaggaacaggcggcagcaccacacccatcattcatctcaagggagatagaaatagcctcaagtgtctgaggtataggctcaggaaacactccgaccattatagagatatttccagcacatggcactggaccggcgctggcaacgaaaagaccggcattctcacagtcacataccattccgagacccaaaggaccaaattcctgaacacagtggccatccctgattccgtgcagatcctggtcggatacatgacaatgggaggcggaggcggaatggagaccctctcccagaggctcaacgtctgtcaagacaaaatcctcgaacactacgagaacgatagcaagaggctgtgcgaccatattgattattggaagcacatcaggctcgagtgtgtcctcatgtataaggccagagagatgggcatccactccattaatcatcaagtggtgcctgccctgtccgtgagcaaggctaaggctctccaggccattgagctccagatgatgctggagacactgaataataccgagtacaagaatgaggactggacaatgcagcagaccagcctcgagctgtacctgacagctcctaccggatgcctggccaagcatggctacaccgtcgaggtccagtttgatggagacgtgcataatacaatgcattacaccaattggaaatttatttacctctgtatcgacggccagtgcacagtggtcgagggacaggtcaactgtaaaggcatctattatgtgcacgaaggacacatcacctattttgtgaatttcaccgaggaagccaaaaagtacggcaccggcaagaaatgggaagtccacgctggcggacaagtcatcgtgttccctgagagcgtcttctccggaggcaccggaggaagcacaacacctattatccacctgaagggagacgctaatatcctgaagtgcctcagatatagactcagcaaatacaagcaactctatgagcaggtcagctccacatggcattggacctgcaccgatggaaagcacaaaaatgccattgtgaccctcacatatattagcaccagccagagggacgattttctcaacaccgtgaagatccccaacaccgtcagcgtgtccacaggctatatgaccatcggaggcggaggcggaatggaggagatttccgccagactgaacgctgtgcaggaaaagattctcgacctctacgaggccgataagacagatctccctagccagattgaacattggaaactcattaggatggaatgtgctctgctgtataccgccaagcaaatgggcttcagccacctgtgccaccaggtggtccctagcctcctggcctccaagaccaaagccttccaagtgattgaactccaaatggctctggaaaccctctccaagtcccagtatagcacatcccaatggacactgcagcaaaccagcctggaagtgtggctctgcgagccccctaaatgtttcgccaagcagggcgagaccgtcacagtccagtacgataatgataagaaaaacaccatggactacacaaactggggcgaaatttatattatcgaggaagacacctgcaccatggtgaccggcaaagtggactacatcggaatgtactatattcacaattgtgagaaggtgtattttaaatacttcaaggaggatgccgccaagtatagcaaaacccagatgtgggaggtccacgtgggcggacaggtgatcgtgtgccccacaagcatttccagcggcggaacaggaggttctgtcgctcctatcgtgcacctgaaaggcgagagcaatagcctgaaatgtctcaggtatagactcaaaccttacaaagagctctattcctccatgagctccacctggcactggacatccgataacaaaaactccaagaacggcatcgtcaccgtgacctttgtgaccgagcagcaacagcaaatgttcctgggcaccgtcaagattccccccaccgtgcagattagcaccggattcatgaccctgggaggcggaggaggaatgaagatgcagacacctaaggaatccctctccgaaaggctcagcgccctccaagataaaattctggaccattatgaaaacgattccaaggacattaatagccaaatttcctattggcagctgattaggctggagaatgccattctgttcaccgctagagagcacggcattaccaagctgaatcaccaggtggtgccccctatcaacatctccaaatccaaagctcataaggccatcgaactccagatggctctgaagggactcgcccaaagcaaatacaacaacgaggaatggaccctccaggacacctgcgaagagctgtggaacaccgagcccagccaatgttttgctaagggaggcaagaccgtgcacgtgtacttcgatggcaataaagacaactgtatgaattacgtggtgtgggactccatttactatattacagagaccggaatttgggataagaccgccgcttgcgtgtcctattggggagtctattacatcaaggacggcgacacaacctactatgtgcaatttaaaagcgaatgcgaaaagtacggaaacagcaacacctgggaagtccagtatggaggcaatgtcatcgactgcaacgacagcatgtgtagcggcggaacaggaggctccacaacacccattatccacctgaagggcgacaaaaactccctcaagtgtctcaggtacagactcaggaaatacgctgatcactatagcgaaatcagctccacatggcactggacaggctgcaacaaaaatacaggcatcctgaccgtgacctataactccgaagtgcagagaaacacctttctcgatgtcgtgacaatccccaactccgtgcaaatcagcgtcggctacatgaccatcggcggcggcggaggaatggaatccatccctgctagactcaacgccgtccaagagaagattctggacctgtatgaagccgactccaacgatctcaacgcccaaatcgaacactggaagctgaccagaatggaatgtgtgctcttctacaaggctaaggaactgggcattacacacatcggacaccaagtggtccctcctatggctgtgtccaaagctaaagcctgtcaggctatcgaactgcaactcgctctcgaggctctcaacaagacacagtacagcaccgacggatggacactccaacagaccagcctggagatgtggagagccgagccccaaaagtacttcgccaaacatggatacacaattacagtccaatacgacaacgacaaaaataacaccatggattataccaattggaaggagatttacctgctgggcgaatgtgaatgcaccatcgtcgaaggccaggtggattactacggcctgtattactggtgcgatggcgagaaaatctacttcgtgaagtttagcaatgacgctaagcagtactgcgtgaccggcgtgtgggaggtccatgtcggcggccaagtgattgtgtgccccgcctccgtgagctccggaggaacaggaggttctacagcccccattatccatctgaaaggagatcctaacagcctcaaatgcctgaggtacagggtgaaaacccacaaaagcctctacgtgcagatcagctccacctggcattggacctccaacgagtgtacaaataataagctgggcatcgtgaccattacatatagcgacgagacccagagacaacagttcctgaagacagtgaaaatccctaacacagtgcaggtgatccagggagtcatgtccctgggcggaggcggaggcatggaggagatctccgctagactctccgccgtgcaggataagatcctggacatttacgaggctgacaaaaatgatctgacctcccagatcgaacattggaagctcatcaggatggaatgcgccatcatgtacacagccaggcagatgggaattagccatctgtgtcatcaggtcgtgcctagcctcgtggctagcaaaaccaaggcctttcaggtgattgaactccagatggctctggagaccctgaatgctagcccctacaagaccgacgagtggaccctgcaacagacctccctcgaagtctggctgtccgagccccagaagtgctttgccaaaaaaggaattaccgtgacagtgcagtatgataacgataaagctaataccatggattacacaaattggtccgaaatctacatcattgaagaaaccacatgcaccctcgtggccggagaggtggattacgtgggactgtactacattcacggaaatgagaagacctattttaagtactttaaggaggacgccaagaaatactccaagacccagctctgggaggtgcatgtgggaagcagagtcattgtgtgccctacatccattcccagcggcggaacaggcggctccgtgtcccctattgtccatctgaaaggagaccccaattccctcaaatgcctcaggtacaggctcaagcctttcaaggacctctattgcaacatgtcctccacctggcactggacctccgatgacaagggagacaaagtgggcatcgtgacagtgacctatacaacagagacacagaggcagctgttcctgaacaccgtcaaaatcccccctaccgtgcaaattagcacaggagtgatgagcctcggcggaggcggcggcagggctcactacaacattgtcaccttctgttgtaagtgtgacagcacactgaggctctgcgtccagtccacacacgtggacatcaggaccctcgaggacctgctgatgggaacactgggcatcgtgtgtcccatctgttcccaaaaacccaccctccacgagtacatgctcgacctgcaacccgaaaccaccgatctctacggctaccaacagctgggcggaggcggaggaagacacaccatgctgtgcatgtgctgtaaatgtgaggccaggattaagctcgtggtcgagtcctccgctgatgatctgagggctttccagcagctcttcctcaataccctgagcttcgtgtgcccctggtgtgccagccaacagaccctgcaagacatcgtgctccatctggagccccagaatgagatccctgtggacctgctcggccatcagcaactcagcgatagcgaggaggaaaacgatgagatcgattga

SEQ ID NO: 140 - DNA, 5586 bp, artificial
  synthetic polynucleotide
atggctaaagccgccatgctggctaaatttaaggaactgtatggagtgagcttctccgagctcgtgaggcctttcaagagcaataagagcacctgctgtgattggtgtatcgccgctttcggcctgacaccttccattgccgacagcattaagaccctgctgcaacagtattgcctctatctccacatccagagcctggcctgtagctggggaatggtggtgctgctgctggtcagatataagtgcggcaagaatagagaaacaatcgagaagctcctgagcaagctgctgtgtgtctcccctatgtgtatgatgattgagcctcccaaactcaggtccaccgccgccgccctgtactggtacaagaccggcatcagcaacattagcgaggtctatggagacacccccgaatggattcagaggcaaaccgtgctgcagcacagctttaacgactgcacattcgagctgtcccaaatggtccaatgggcctatgataacgacatcgtcgatgactccgaaatcgcctacaaatacgcccaactcgctgacacaaactccaacgccagcgctttcctgaagtccaactcccaggccaagattgtcaaggattgtgccaccatgtgcagacattataaaagggccgagaaaaagcagatgagcatgtcccagtggatcaagtatagatgcgatagagtggatgacggcggcgattggaagcaaattgtcatgttcctcaggtaccagggcgtggagtttatgagcttcctgaccgccctgaaaaggtttctgcagggaattcccaagaagaactgtatcctgctgtacggcgccgctaatacagataagagcctgttcggcatgtccctcatgaagttcctgcaaggctccgtcatctgcttcgtgaatagcaaatcccacttctggctccagcccctcgccgatgccaaaattggtatgttagacgatgccaccgtgccctgctggaattacatcgatgacaacctcagaaacgccctggacggcaacctggtgtccatggatgtgaaacataggcccctggtccagctcaaatgtccccccctcctgatcacatccaacatcaatgccggcaccgactccaggtggccctacctccacaataggctggtcgtgttcaccttccccaatgagtttcccttcgatgagaacggaaaccctgtctatgagctgaatgataaaaactggaagagctttttcagcaggacctggagcagactgtccctgggcggcggcggcggcgacccccaagagagacccaggaagctccctcagctgtgcaccgaactccaaacaacaatccatgacattatcctcgagtgcgtgtattgtaagcaacagctgctgaggagggaggtctatgacttcgctaggagggacctgtgtatcgtgtacagagacggcaacccttacgccgtctgcgacaagtgcctgaagttctactccaagatctccgagtatagacattattgctactccctctacggaacaaccctggagcagcaatacaacaaacctctctgcgacctgctgattaggaggatcaattgccaaaagcctctctgtcccgaagagaagcaaagacacctggacaagaagcagagatttcacaacatcaggggcagatggaccggcaggtgtatgtcctgttgtaggagcagcggaggaggcggcggcgatcccaccagaagaccctataaactgcccgatctctgtacagagctgaacacatccctgcaggacatcgaaatcacatgcgtctactgtaaaaccgtgctggagctgaccgaggtgttcgagttcgctaggaaggacctgttcgtcgtgtacagggatagcattcctcacgctgcctgccacaagtgcattgatttctattccaggatcagagagctgagacactattccgatagcgtctacggcgataccctggagaagctgaccaacacaggcctgtacaacctgctcatcagaagactgaggtgtcaaaagcccctgaatcccgccgaaaaactcaggcacctcaacgagaagaggaggtttcacaatatcgctggccactacaggggccaatgccattcctgctgtaacagagccggcggaggaggcggcaatcccgctgaaagacccaggaaactgcacgaactctcctccgctctggaaatcccttacgatgagctgaggctgaactgcgtgtactgcaagggccaactcacagagaccgaagtgctggactttgctaggaccgatctgaccatcgtgtacagggatgataccccccatggcgtgtgtacaaagtgtctgagattttacagcaaagtcagcgagttcagatggtacaggtacagcgtgtacggcaccacactggaaaaactcaccaacaagggcatctgtgacctgctgatcaggagaatcacctgccaaaggcccctgtgtcccgaagaaaagcagaggcatctggataagaaaaagaggtttcataacatcggaggaaggtggaccggaagatgcattgcctgttggaggaggcccggcggaggaggaggcgataccgaagagaaacccaggaccctgcatgatctctgtcaggccctggagaccaccatccacaacatcgaactgcagtgtgtggaatgcaagaagcccctgcaaagatccgaggtgtacgattttgccagagccgatctgacagtggtgtacagggagggcaacccctttggcatttgcaaactctgcctgagattcctgtccaaaatttccgagtataggcattataattacagcgtctatggaaacacactcgagcagaccgtgaaaaaacccctgaacgagatcctgattagaaggatcatctgccagagacccctgtgtcctcaggaaaagaaaagacacgtggatctcaacaaaaggtttcataatatctccggcaggtgggctggcagatgtgctgcctgctggaggagcagaggaggcggaggcggcgaccccaagcagaggccctacaaactgcccgacctctgcacagagctgaataccagcctgcaggacgtgtccatcgcttgtgtgtattgcaaggctacactggaaaggaccgaggtgtaccagtttgccaggaaagacctgtgcatcgtgtatagggattgcatcgcctacgctgcttgccacaaatgcattgacttctactccagaatcagggagctgagatactactccaacagcgtgtatggcgaaaccctcgagaaaatcacaaatacagaactgtataatctcctcatcaggaggctgaggtgtcagaagcctctgaaccccgccgaaaagagaaggcacctcaaggacaaaagaagattccattccattgccggccagtataggggccagtgtaacacatgttgtgaccaggctggaggaggcggaggagatcctgctaccagacccagaaccctccacgaactgtgcgaggtgctggaggagtccgtgcacgagatcagactgcagtgcgtccagtgtaagaaggagctgcagaggagggaagtctacaagtttctgaggaccgatctcagaatcgtctatagggacaataacccttacggcgtgtgcatcatgtgtctcaggttcctgagcaagatttccgaatacagacattaccaatacagcctgtatggcaaaaccctggaggagagagtcaagaagcctctctccgagatcaccatcaggaggatcatctgtcaaacacctctgtgccccgaggaaaaagagaggcacgtgaatgctaataagaggttccataatatcatgggaaggtggaccggaaggtgcagcgagtgctggagacctagaggaggaggcggcggcgatgctgaggaaaagcccaggaccctgcacgatctgtgtcaagccctggaaacatccgtccacgagatcgaactgaaatgtgtcgagtgcaaaaagacactccagaggtccgaggtctatgatttcgtcagggctgatctgagaattgtgtatagggacggcaatccttttgccgtgtgtaaggtgtgcctgaggctgctcagcaaaatttccgaatatagacactataactactccctgtatggagacacactggaacagaccctcaagaagtgtctgaatgagattctgatcaggagaatcatttgtcagaggcccctgtgccctcaagagaagaagaggcatgtggacctgaacaagaggttccacaatatcagcggcaggtggaccggaaggtgtgctgtctgctggaggcctagaggaggcggaggaggcaagcagggcgctatgctcgccgtctttaaggacacctacggactgagcttcaccgatctggtgagaaacttcaagtccgataagacaacctgtacagactgggtgacagctatcttcggagtgaatcccacaatcgccgagggcttcaaaaccctgattcagcctttcatcctctatgcccacatccagtgtctggactgtaagtggggagtgctgattctggccctcctcaggtataagtgcggaaagagcaggctgacagtggccaaaggcctgtccaccctcctgcacgtccctgagacctgtatgttaatccaaccccccaagctcagaagcagcgtcgctgctctgtattggtacaggacaggcatcagcaatatctccgaagtgatgggagatacccccgagtggattcaaaggctgaccatcatccaacatggcatcgacgactccaattttgacctgagcgagatggtgcagtgggctttcgacaacgaactgacagatgagagcgacatggctttcgaatacgccctcctcgctgatagcaatagcaatgccgctgccttcctgaagagcaattgccaggctaagtacctgaaagattgtgctaccatgtgcaagcactatagaagggctcagaagaggcaaatgaatatgtcccaatggatcaggtttaggtgcagcaaaattgatgaaggaggcgactggagacccatcgtccaattcctgaggtatcagcagatcgagttcatcaccttcctgggcgccctcaagtcctttctcaagggaacacccaagaagaattgcctcgtcttttgcggccctgctaacacagacaaatcctattttggcatgtcctttattcactttattcagggcgccgtcatcagcttcgtgaacagcacaagccacttttggctggaacctctcaccgataccaaggtggctatgctcgacgacgccaccaccacatgctggacatacttcgatacatacatgagaaacgccctcgatggaaaccccatctccattgacaggaagcacaaacccctcatccaactgaagtgcccccccatcctgctgaccacaaacatccaccctgccaaggataacaggtggccttacctcgagtccagaatcacagtgttcgagtttcccaacgccttccctttcgacaaaaacggaaaccccgtctatgaaatcaatgataaaaattggaaatgcttcttcgagagaacctggtccaggctcgacctgtga

SEQ ID NO: 141 - DNA, 5586 bp, artificial
  synthetic polynucleotide
atggctaaggccgctatgctggctaagtttaaggaactctacggagtgagcttctccgagctggtgagacccttcaagtccaataagagcacatgctgtgactggtgtatcgctgccttcggactcacacccagcatcgctgacagcatcaagaccctgctccagcagtactgtctgtatctccacatccaaagcctcgcttgcagctggggaatggtcgtgctgctgctggtgagatacaagtgcggaaaaaatagggagacaatcgagaagctgctcagcaagctgctgtgcgtctcccccatgtgtatgatgatcgaaccccccaagctcagaagcacagccgctgccctgtactggtataaaaccggaattagcaatatcagcgaagtctatggcgacacccccgagtggattcaaagacaaaccgtcctccagcacagcttcaatgactgcacctttgagctgtcccagatggtgcagtgggcctacgataatgacatcgtggatgacagcgaaatcgcctacaagtacgctcaactggccgacaccaactccaacgcctccgccttcctgaagtccaatagccaagccaagatcgtgaaagattgtgccaccatgtgtagacattacaaaagggccgagaagaagcaaatgagcatgagccaatggattaagtacagatgcgatagggtggatgacggcggcgattggaagcagatcgtgatgttcctgagataccagggcgtcgagtttatgagctttctgaccgccctgaagaggtttctccagggaatccccaagaagaactgtattctgctgtacggagccgccaacacagataagagcctcttcggcatgtccctcatgaagttcctgcagggcagcgtgatttgttttgtgaacagcaagtcccacttctggctgcaacctctcgctgacgctaagattggtatgttagatgatgccaccgtcccctgctggaattacatcgatgacaacctcagaaacgccctcgacggcaatctcgtctccatggatgtgaaacacagacccctcgtgcagctcaagtgtccccctctgctcattacctccaatatcaacgccggcaccgactccagatggccctacctgcataataggctggtggtcttcaccttccctaacgagttccccttcgacgagaacggcaatcctgtgtatgagctgaacgacaaaaattggaagagcttcttttccagaacctggtccaggctgtccctgggcggaggaggcggaaaacagggagccatgctcgctgtctttaaggatacatatggcctgtcctttacagatctcgtgaggaacttcaagtccgataaaacaacctgtaccgactgggtcaccgctatcttcggagtgaatcccaccatcgccgagggatttaagacactcatccagccttttattctgtacgcccacatccaatgcctcgattgcaagtggggcgtcctgatcctggccctgctcagatacaaatgtggcaagtccaggctgaccgtcgctaagggcctgtccaccctgctccatgtgcctgaaacctgtatgttaattcaacctcccaaactgaggagcagcgtggccgccctctattggtataggaccggcattagcaatatttccgaggtgatgggcgacacccctgagtggattcaaagactcaccattatccagcacggcatcgatgacagcaactttgacctgagcgaaatggtgcaatgggctttcgataatgagctcacagacgagtccgacatggcttttgagtacgctctcctggctgattccaacagcaatgctgccgcctttctgaaatccaattgtcaggccaagtacctgaaagactgcgctaccatgtgcaaacattataggagggcccagaagaggcaaatgaacatgtcccagtggattagattcaggtgctccaagatcgacgagggaggcgattggagacctatcgtgcagttcctcaggtaccagcagatcgagttcattacattcctgggcgctctcaaaagcttcctgaagggcacccctaagaagaattgcctcgtgttttgcggccccgccaacaccgacaaatcctacttcggcatgagcttcatccacttcattcaaggcgccgtgatctccttcgtgaacagcacatcccatttctggctggaacccctcaccgataccaaagtggccatgctggacgatgccaccaccacctgttggacctatttcgatacctacatgaggaatgccctcgatggcaatcctatctccattgacaggaaacataaacccctcatccagctgaagtgccctcctattctgctcacaacaaacatccatcccgccaaggacaacagatggccttacctcgaaagcaggatcaccgtcttcgagttccctaacgcttttcccttcgacaagaacggcaaccccgtctacgaaatcaatgataaaaactggaaatgctttttcgaaaggacctggagcaggctcgatctgggaggcggaggcggcgatccccaagaaaggcctaggaaactcccccaactgtgtacagaactgcaaaccaccatccatgacattattctcgagtgtgtctactgcaagcaacagctgctcaggagagaggtgtacgacttcgccagaagggacctgtgtatcgtgtacagggatggcaacccttatgccgtgtgtgataagtgtctcaagttctattccaagatctccgaatacagacactactgctattccctgtatggcaccaccctggagcaacagtataacaaacctctgtgtgatctgctcatcagaagaatcaattgccagaagcctctgtgccccgaagagaaacaaagacacctcgacaagaaacaaaggttccacaacattaggggcaggtggacaggaaggtgcatgtcctgttgcagaagcagcggaggaggaggcggcgaccccaccaggagaccctataagctccccgacctgtgcacagaactcaataccagcctgcaagacattgagatcacatgtgtctattgcaagacagtgctcgagctcaccgaggtgttcgagtttgctaggaaggacctgtttgtggtgtacagagacagcattccccatgccgcttgtcacaagtgcattgatttctattccaggattagggagctgagacactacagcgatagcgtgtatggcgataccctggagaagctgaccaataccggactgtacaatctcctgatcagaaggctgaggtgccagaaacctctgaatcccgccgagaagctcaggcacctgaacgagaagagaagatttcacaacattgccggccattataggggccagtgccacagctgttgtaacagggccggaggcggcggaggcgataccgaagaaaaacccaggaccctgcatgacctctgccaagccctggaaacaaccatccacaatatcgaactgcagtgcgtcgagtgcaagaaacctctccagaggtccgaggtctatgatttcgccagagctgacctcaccgtcgtctatagggagggaaacccctttggcatctgtaagctgtgcctgagatttctctccaagattagcgagtacagacattataactacagcgtctatggcaatacactcgaacagaccgtgaaaaagcctctcaacgaaattctcattagaaggatcatttgccaaagacccctctgcccccaggagaagaagagacatgtggacctgaataagagattccacaatattagcggcagatgggccggcagatgcgccgcctgttggagaagcaggggaggaggaggaggcgaccccaaacagaggccctacaagctgcctgatctgtgcaccgagctcaacaccagcctccaagacgtcagcattgcttgcgtgtactgcaaggccaccctcgagaggacagaagtgtatcagttcgccaggaaagacctctgcatcgtctacagagattgcatcgcctacgccgcctgtcataaatgtatcgacttttactccaggattagggaactcagatactactccaattccgtgtacggcgagaccctcgaaaagatcaccaataccgagctgtataacctgctcattaggagactgaggtgtcagaaacctctcaatcctgccgagaagaggaggcacctcaaggacaagaggaggtttcacagcatcgccggccagtacagaggacagtgtaacacctgttgcgatcaggccggaggaggcggaggagatcctgctaccaggcccagaaccctccacgagctctgcgaggtcctggaagaatccgtgcacgaaatcaggctccaatgtgtgcagtgtaagaaggagctccagaggagggaggtgtacaagttcctgagaaccgatctcagaatcgtgtacagagataacaacccctacggcgtgtgtattatgtgtctgagattcctgagcaaaatcagcgagtataggcactatcaatatagcctgtacggaaaaaccctggaggaaagagtgaaaaaacccctcagcgagattaccatcagaagaatcatctgccagacacccctgtgtcccgaagagaaggaaaggcatgtcaatgccaacaagaggtttcataacatcatgggcagatggacaggcagatgctccgaatgctggagacctaggggcggaggaggcggagatgccgaggaaaaacccagaaccctgcacgatctgtgccaagctctcgagacctccgtgcatgaaatcgaactgaagtgcgtggagtgtaagaaaaccctccagaggagcgaagtgtatgacttcgtgagggccgacctcagaatcgtgtatagagatggaaaccccttcgccgtctgtaaggtgtgtctgaggctgctgtccaagatcagcgaatacaggcactacaactatagcctctacggcgatacactcgagcagaccctcaagaaatgcctgaatgaaattctcatcaggagaatcatctgtcagagacccctgtgccctcaggaaaagaagagacacgtggacctcaataaaaggtttcacaatatcagcggcaggtggaccggcaggtgcgctgtgtgttggagacccagaggaggaggcggaggcaatcccgccgaaaggcccagaaagctgcacgaactgagctccgccctggagatcccctacgacgagctgaggctgaattgcgtgtattgtaagggacagctcacagagaccgaagtgctggatttcgccaggacagatctgacaatcgtgtacagagatgacacacctcacggcgtctgtaccaagtgcctgaggttttatagcaaggtcagcgagttcagatggtacagatacagcgtctacggaaccacactcgagaaactgaccaacaagggcatctgcgacctcctgatcaggagaattacatgtcagaggcccctctgtcctgaggaaaaacaaaggcacctggacaagaagaagaggttccataacatcggaggaagatggacaggaagatgcatcgcttgttggaggaggccctga

SEQ ID NO: 142 - DNA, 9993 bp, Artificial
  synthetic polynucleotide
ataggcggcgcatgagagaagcccagaccaattacctacccaaaatggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgatggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctcagaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgacatagtctagtccgccaagggcgcgcccacccagcggccgcatacagcagcaattggcaagctgcttacatagaactcgcggcgattggcatgccgccttaaaatttttattttatttttcttttcttttccgaatcggattttgtttttaatatttcaaaaaaaaaaaaaaaaaaaaaaaaaaaaaaaaaaaaaaaagaagagcgtttaaacacgtgatatctggcctcatgggccttcctttcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgaatacacggtgcctgactgcgttagcaatttaactgtgataaactaccgcattaaagcttatcgatgataagctgtcaaacatgagaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacacgcgtaatacgactcactatag

SEQ ID NO: 143 - protein, 1171 aa, Artificial
  synthetic polypeptide
METLCQRLNVCQDKILTHYENDSTDLRDHIDYWKHMRLECAIYYKAREMGFKHINHQVVPTLAVSKNKALQAIELQLTLETIYNSQYSNEKWTLQDVSLEVYLTAPTGCIAKHGYTVEVQFDGDICNTMHYTNWTHIYICEEASVTVVEGQVDYYGLYYVHEGIRTYFVQFKDDAEKYSKNKVWEVHAGGQVILCPTSVFSGGTGGSTTPIVHLKGDANTLKCLRYRFKKHCTLYTAVSSTWHWTGHNVKHKSAIVTLTYDSEWQRDQFLSQVKIPKTITVSTGFMSIGGGGGMQTPKETLSERLSCVQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFAKGGQTVQVYFDGNKDNCMTYVAWDSVYYMTDAGTWDKTATCVSHRGLYYVKEGYNTFYIEFKSECEKYGNTGTWEVHFGNNVIDCNDSMCSGGTGGSTTPIIHLKGDRNSLKCLRYRLRKHSDHYRDISSTWHWTGAGNEKTGILTVTYHSETQRTKFLNTVAIPDSVQILVGYMTMGGGGGMETLSQRLNVCQDKILEHYENDSKRLCDHIDYWKHIRLECVLMYKAREMGIHSINHQVVPALSVSKAKALQAIELQMMLETLNNTEYKNEDWTMQQTSLELYLTAPTGCLAKHGYTVEVQFDGDVHNTMHYTNWKFIYLCIDGQCTVVEGQVNCKGIYYVHEGHITYFVNFTEEAKKYGTGKKWEVHAGGQVIVFPESVFSGGTGGSTTPIIHLKGDANILKCLRYRLSKYKQLYEQVSSTWHWTCTDGKHKNAIVTLTYISTSQRDDFLNTVKIPNTVSVSTGYMTIGGGGGMEEISARLNAVQEKILDLYEADKTDLPSQIEHWKLIRMECALLYTAKQMGFSHLCHQVVPSLLASKTKAFQVIELQMALETLSKSQYSTSQWTLQQTSLEVWLCEPPKCFAKQGETVTVQYDNDKKNTMDYTNWGEIYIIEEDTCTMVTGKVDYIGMYYIHNCEKVYFKYFKEDAAKYSKTQMWEVHVGGQVIVCPTSISSGGTGGSVAPIVHLKGESNSLKCLRYRLKPYKELYSSMSSTWHWTSDNKNSKNGIVTVTFVTEQQQQMFLGTVKIPPTVQISTGFMTL

SEQ ID NO: 144 - DNA, 3519 bp, Artificial
  synthetic polynucleotide
atggaaaccctgtgtcagaggctgaatgtgtgtcaagacaaaatcctgacccactacgagaatgactccacagacctgagggaccacatcgattactggaagcacatgaggctcgagtgcgccatctactataaggccagagagatgggctttaagcatatcaatcatcaagtcgtgcccacactggccgtgagcaagaacaaggccctgcaagctattgagctccaactgaccctcgagaccatctacaacagccagtacagcaacgagaaatggacactgcaggatgtgtccctcgaagtgtacctcacagcccctaccggatgtatcgccaagcacggctacacagtggaagtgcagtttgacggcgatatctgcaatacaatgcattacaccaactggacccacatctatatctgcgaggaagctagcgtcacagtggtggagggccaggtcgactattacggcctctattacgtgcatgagggcatcaggacctactttgtgcagtttaaggacgatgccgaaaaatacagcaaaaataaagtgtgggaagtccatgccggaggccaggtgatcctgtgtcccacctccgtctttagcggaggcaccggcggcagcacaacccctatcgtccacctgaaaggagatgccaacacactgaaatgtctcaggtacaggttcaagaagcactgtaccctgtatacagccgtcagcagcacatggcattggaccggccacaacgtcaagcataagagcgccatcgtgaccctcacatacgatagcgaatggcaaagggaccagttcctgagccaggtcaagatccccaagacaatcacagtgtccaccggctttatgtccatcggcggaggaggcggaatgcagacccctaaggagaccctcagcgaaagactcagctgcgtgcaggataaaatcattgaccattatgagaatgattccaaggacatcgatagccagattcaatactggcagctgatcaggtgggagaacgccatcttcttcgccgccagggagcacggcattcaaaccctcaaccatcaggtggtgcccgcttacaacatcagcaagagcaaagcccataaggccattgagctgcagatggccctccagggcctggctcagagcgcttataaaaccgaagactggaccctgcaagacacatgcgaggagctgtggaacaccgaacccacacactgcttcgccaaaggcggccaaacagtgcaggtgtacttcgatggcaacaaggacaattgcatgacctacgtcgcttgggactccgtctattacatgacagatgccggcacatgggacaagaccgccacatgcgtcagccacaggggactgtactacgtgaaagagggatacaataccttctacatcgagttcaaatccgagtgtgagaagtacggcaatacaggcacctgggaggtgcatttcggcaataatgtgattgactgcaacgatagcatgtgtagcggcggaaccggcggttctacaacccccatcatccacctgaagggcgaccgtaattctctgaagtgcctgaggtacagactcaggaagcacagcgaccattacagggatatctccagcacctggcactggacaggcgctggcaatgaaaagacaggaatcctcacagtgacctaccactccgagacccagaggacaaaattcctgaacaccgtggccatccccgacagcgtccagattctggtgggctatatgaccatgggaggaggcggaggcatggagacactcagccaaaggctcaacgtgtgccaggataagatcctggagcactacgagaacgacagcaaaaggctgtgtgatcatatcgactactggaagcatatcaggctggagtgcgtcctgatgtacaaggccagagaaatgggaatccattccatcaaccaccaagtggtccctgctctctccgtcagcaaagccaaggctctgcaggctattgaactgcaaatgatgctggagaccctcaacaacaccgagtacaaaaacgaggattggaccatgcaacagacctccctcgaactctatctgacagcccccacaggctgcctcgccaagcatggctacaccgtggaggtgcaattcgacggcgatgtccacaacacaatgcactacacaaactggaagttcatctacctctgcatcgacggacagtgtaccgtcgtggaaggacaagtgaactgcaagggcatctactacgtccacgagggccacattacctacttcgtgaacttcaccgaggaagccaagaaatacggcaccggaaagaagtgggaggtccacgccggcggccaagtcattgtgtttcctgaaagcgtcttcagcggaggcacaggcggctccaccacacccatcatccatctgaaaggcgatgccaacatcctcaaatgcctcaggtataggctgagcaaatacaaacaactgtacgaacaagtgtcctccacctggcattggacatgtaccgacggcaagcacaaaaacgccatcgtcaccctgacctacattagcaccagccagagagacgacttcctcaatacagtgaagatccctaacaccgtgagcgtgagcaccggctacatgacaattggaggcggcggcggcatggaagagatttccgccagactcaacgccgtgcaggagaaaatcctggacctctacgaggccgataaaaccgatctcccctcccagattgagcactggaagctgatcagaatggaatgcgccctgctctacaccgccaaacagatgggcttctcccacctctgccaccaggtcgtgccctccctcctggcttccaagaccaaggccttccaggtgatcgagctgcaaatggctctcgaaaccctgtccaagagccagtatagcacctcccaatggaccctgcagcaaacctccctggaagtctggctgtgtgaaccccccaaatgcttcgctaagcaaggcgagaccgtcacagtccagtacgacaatgataagaagaataccatggactataccaactggggcgagatctacattatcgaggaggatacctgcaccatggtgaccggcaaggtggactatattggaatgtactatatccataactgcgagaaagtctatttcaagtatttcaaagaggacgccgccaaatacagcaagacccagatgtgggaggtgcacgtcggaggacaggtgattgtctgtcctacctccatctcctccggcggaacaggcggaagcgtggcccctattgtccatctcaagggcgagagcaactccctgaagtgtctcaggtatagactgaagccctacaaggagctgtactccagcatgagctccacctggcactggaccagcgataacaagaacagcaagaacggcatcgtgacagtgacattcgtgacagaacagcagcagcagatgttcctcggcacagtgaaaattccccccaccgtgcaaattagcaccggcttcatgacactgtgatga

SEQ ID NO: 145 - protein, 1046 aa, Artificial
  synthetic polypeptide
MKMQTPKESLSERLSALQDKILDHYENDSKDINSQISYWQLIRLENAILFTAREHGITKLNHQVVPPINISKSKAHKAIELQMALKGLAQSKYNNEEWTLQDTCEELWNTEPSQCFAKGGKTVHVYFDGNKDNCMNYVVWDSIYYITETGIWDKTAACVSYWGVYYIKDGDTTYYVQFKSECEKYGNSNTWEVQYGGNVIDCNDSMCSGGTGGSTTPIIHLKGDKNSLKCLRYRLRKYADHYSEISSTWHWTGCNKNTGILTVTYNSEVQRNTFLDVVTIPNSVQISVGYMTIGGGGGMESIPARLNAVQEKILDLYEADSNDLNAQIEHWKLTRMECVLFYKAKELGITHIGHQVVPPMAVSKAKACQAIELQLALEALNKTQYSTDGWTLQQTSLEMWRAEPQKYFAKHGYTITVQYDNDKNNTMDYTNWKEIYLLGECECTIVEGQVDYYGLYYWCDGEKIYFVKFSNDAKQYCVTGVWEVHVGGQVIVCPASVSSGGTGGSTAPIIHLKGDPNSLKCLRYRVKTHKSLYVQISSTWHWTSNECTNNKLGIVTITYSDETQRQQFLKTVKIPNTVQVIQGVMSLGGGGGMEEISARLSAVQDKILDIYEADKNDLTSQIEHWKLIRMECAIMYTARQMGISHLCHQVVPSLVASKTKAFQVIELQMALETLNASPYKTDEWTLQQTSLEVWLSEPQKCFAKKGITVTVQYDNDKANTMDYTNWSEIYIIEETTCTLVAGEVDYVGLYYIHGNEKTYFKYFKEDAKKYSKTQLWEVHVGSRVIVCPTSIPSGGTGGSVSPIVHLKGDPNSLKCLRYRLKPFKDLYCNMSSTWHWTSDDKGDKVGIVTVTYTTETQRQLFLNTVKIPPTVQISTGVMSLGGGGGRAHYNIVTFCCKCDSTLRLCVQSTHVDIRTLEDLLMGTLGIVCPICSQKPTLHEYMLDLQPETTDLYGYQQLGGGGGRHTMLCMCCKCEARIKLVVESSADDLRAFQQLFLNTLSFVCPWCASQQTLQDIVLHLEPQNEIPVDLLGHQQLSDSEEENDEID

SEQ ID NO: 146 - DNA, 3144 bp, Artificial
  synthetic polynucleotide
atgaagatgcagacccccaaagaatccctgtccgagaggctcagcgccctgcaggataagatcctcgaccactacgaaaacgactccaaggacatcaactcccagatctcctattggcagctcatcaggctggagaacgctatcctgttcacagccagagagcacggcattaccaagctgaaccatcaagtggtcccccctattaacatctccaaaagcaaggcccacaaggccatcgagctgcaaatggccctcaaaggcctggcccagtccaagtataacaacgaggagtggaccctgcaggatacatgcgaggagctgtggaacaccgagccctcccaatgtttcgccaagggcggcaagacagtgcatgtctatttcgatggcaataaagataactgcatgaactacgtggtgtgggacagcatttactacattaccgaaaccggcatttgggacaagaccgctgcttgcgtcagctattggggcgtgtactacattaaggatggcgataccacctactacgtccagttcaagtccgaatgcgagaaatatggcaattccaacacctgggaagtgcagtatggaggcaatgtgatcgactgcaacgactccatgtgttccggaggaacaggaggaagcacaacccccatcatccatctgaagggagataagaacagcctcaagtgcctgaggtacaggctgaggaaatacgctgaccactactccgaaatctcctccacatggcactggaccggctgcaataagaacaccggaatcctgaccgtgacctacaactccgaggtgcagaggaacaccttcctggatgtcgtgacaatccccaattccgtccagattagcgtcggctacatgacaatcggcggaggaggcggaatggaaagcattcccgccaggctgaatgctgtgcaggaaaaaatcctcgatctgtacgaagccgactccaacgacctgaacgcccagatcgaacactggaaactgaccaggatggaatgcgtcctgttttataaagccaaggagctcggcatcacccatatcggccaccaagtcgtccctcccatggccgtgtccaaggccaaggcctgtcaggctattgagctccagctggccctggaggccctcaataaaacccaatatagcacagacggctggaccctccagcaaaccagcctcgagatgtggagggccgaaccccagaaatactttgccaaacacggctatacaatcacagtgcagtacgataatgacaagaataataccatggactacacaaattggaaagagatctacctgctcggcgagtgtgagtgcaccatcgtcgagggccaggtggattactacggcctgtactactggtgtgatggcgaaaagatctattttgtgaagttctccaacgacgctaagcagtactgtgtcacaggcgtctgggaggtccacgtcggaggccaggtgatcgtctgccctgctagcgtgagcagcggcggaacaggaggctccaccgctcccattattcatctgaaaggcgaccccaattccctgaagtgtctgaggtatagagtcaagacccacaaaagcctctacgtgcagatcagcagcacatggcactggacctccaatgagtgtacaaataataaactgggaatcgtcacaatcacctacagcgatgagacccaaaggcagcagttcctcaaaaccgtcaagatccccaataccgtccaggtgatccaaggcgtcatgtccctcggcggaggaggaggaatggaagagatcagcgccaggctcagcgctgtgcaagacaaaattctggacatctacgaggctgacaagaacgatctcacatcccagatcgagcactggaagctcatcaggatggagtgcgccattatgtacaccgccaggcaaatgggcattagccacctgtgccaccaagtggtgccctccctcgtcgcctccaagaccaaagccttccaggtgatcgagctccaaatggccctggagaccctgaacgccagcccctacaagacagacgagtggacactgcagcagacctccctggaagtctggctgtccgagccccagaagtgctttgctaagaagggcatcaccgtgaccgtgcaatacgacaacgacaaggccaacaccatggattataccaactggagcgaaatctacatcatcgaggagaccacctgtaccctcgtggccggcgaggtcgactacgtgggcctgtattacatccacggaaatgagaaaacatactttaaatattttaaggaggacgccaaaaaatatagcaagacacaactgtgggaggtgcacgtcggcagcagggtgattgtgtgtcctaccagcatccctagcggaggcacaggaggctccgtgtcccctattgtccacctgaaaggcgatcctaattccctgaaatgcctgaggtataggctcaaacccttcaaggacctctactgcaacatgagctccacatggcattggacaagcgacgataagggcgataaggtgggcattgtgaccgtgacctacaccaccgaaacccagaggcaactgttcctcaacaccgtgaagatccctcctacagtccagatctccaccggcgtgatgtccctgggaggcggaggaggccgtgctcattataacatcgtgaccttctgttgcaaatgtgactccaccctgagactctgtgtccagtccacccacgtggacattagaaccctggaagacctgctcatgggcacactgggcattgtgtgtcccatctgctcccagaagcccaccctccatgagtacatgctggacctgcagcccgagaccacagacctgtacggctaccaacagctgggcggaggaggaggaagacacaccatgctgtgtatgtgctgcaagtgtgaggctaggatcaagctcgtggtcgagagcagcgccgatgacctcagagcctttcagcagctgtttctgaacaccctgagcttcgtgtgtccttggtgtgcctcccagcagaccctgcaagacatcgtcctgcatctggagccccagaacgaaattcccgtggacctgctgggccatcagcagctctccgactccgaggaggaaaacgacgagatcgattgatga

SEQ ID NO: 147 - protein, 1861 aa, Artificial; identical to SEQ ID NO: 136
  synthetic polypeptide

SEQ ID NO: 148 - DNA, 5589 bp, Artificial
  synthetic polynucleotide
atggctaaggccgccatgctcgctaagtttaaggaactgtacggcgtctccttttccgagctcgtgagacctttcaagtccaacaagtccacctgctgtgactggtgcattgctgccttcggcctgacaccctccatcgccgactccatcaagacactgctgcaacagtactgcctgtatctgcacatccagagcctggcttgcagctggggaatggtggtgctgctgctcgtcaggtacaagtgcggcaagaacagggaaaccattgagaagctgctgagcaagctgctgtgcgtcagccctatgtgcatgatgattgagccccctaagctcaggagcacagctgccgctctctattggtacaaaaccggaatctccaacatcagcgaggtgtacggcgacacccctgagtggattcaaaggcaaacagtgctccagcatagcttcaacgattgcaccttcgagctgagccaaatggtgcaatgggcctacgataacgacatcgtggatgatagcgagattgcttacaaatatgcccagctggccgacacaaacagcaacgcctccgctttcctgaagtccaacagccaagccaaaatcgtgaaggactgcgctaccatgtgtaggcactacaaaagagccgagaagaagcaaatgagcatgagccagtggatcaaatatagatgcgacagggtcgacgatggaggagattggaagcagatcgtcatgtttctcagataccagggcgtggaatttatgagctttctgaccgccctgaagagatttctccagggcatccctaaaaagaactgtattctgctgtatggcgctgccaacaccgacaaaagcctgttcggaatgagcctcatgaagtttctgcagggcagcgtgatctgtttcgtgaacagcaagagccatttctggctccagcccctcgctgacgccaagatcggaatgctggacgacgctaccgtcccttgctggaactacatcgatgataatctcagaaacgctctggatggcaacctggtgagcatggacgtcaagcacagacccctggtccaactgaaatgtccccctctcctcatcacaagcaacattaacgccggcaccgatagcaggtggccctatctccataacagactggtggtgtttaccttccccaacgaatttcccttcgacgaaaacggcaatcctgtgtacgagctcaacgacaaaaactggaagtccttcttcagcagaacatggtccagactgagcctcggaggaggaggaggaaaacaaggagccatgctcgccgtcttcaaggacacctacggcctcagctttaccgacctcgtcagaaactttaaatccgataaaaccacctgcacagattgggtgaccgccattttcggagtgaatcccaccattgccgaaggcttcaagacactgatccaacctttcatcctgtacgcccacattcagtgtctcgactgtaagtggggcgtgctgattctggccctgctgagatacaaatgcggcaagtccagactcacagtggccaagggcctctccacactgctgcatgtccccgagacctgcatgctgattcaacctcccaaactcaggagcagcgtggctgctctgtactggtataggacaggcatttccaacatttccgaggtcatgggagacacacctgaatggattcaaagactgaccatcatccagcacggcatcgatgactccaacttcgacctgagcgaaatggtccagtgggctttcgacaacgagctgaccgacgagtccgacatggccttcgagtacgctctcctcgctgactccaactccaatgctgctgcttttctcaagtccaactgccaggctaagtacctgaaagactgcgccaccatgtgcaagcattacaggcgtgctcaaaaaaggcagatgaatatgtcccaatggattagatttaggtgctccaagatcgatgagggaggcgactggagacccattgtgcagttcctcaggtaccagcagatcgagtttatcacatttctgggagctctgaagtccttcctgaagggcacccccaagaaaaactgtctggtgttctgcggccctgctaatacagataaaagctacttcggcatgtccttcatccactttatccagggcgctgtgatcagcttcgtgaatagcacatcccacttttggctggaacccctcacagacacaaaggtggccatgctggatgacgctacaacaacctgttggacctatttcgatacctacatgaggaacgctctcgacggcaaccctattagcattgatagaaaacacaaacctctgatccagctgaagtgccctcccatcctcctcacaaccaacattcaccccgccaaggacaatagatggccttacctcgagagcaggatcaccgtctttgagtttcctaacgccttcccctttgacaagaacggcaaccccgtgtatgaaatcaatgataaaaattggaaatgtttcttcgagaggacatggagcagactcgatctcggaggcggcggcggagatcctcaggaaaggcctaggaaactcccccagctgtgcaccgagctgcagaccaccattcacgacattatcctggagtgcgtctactgcaagcaacagctgctcagaagggaggtctatgattttgccagaagggatctgtgcattgtgtacagagacggcaatccttatgccgtctgcgataagtgcctgaaattctatagcaaaatctccgaatacagacactactgctacagcctgtatggaaccaccctcgagcagcagtacaataaacccctgtgcgatctgctcatcaggaggatcaactgtcaaaagcccctgtgtcccgaggaaaagcagagacacctggataagaaacagaggttccacaatatcaggggcagatggaccggcagatgcatgtcctgttgtaggtccagcggcggaggaggaggagaccctaccagaaggccctataagctgcctgacctctgcacagaactcaataccagcctgcaggatatcgagatcacatgtgtctattgcaagaccgtgctggaactgaccgaagtgttcgagtttgctaggaaagacctcttcgtcgtgtacagggacagcatcccccatgccgcctgccacaagtgtattgacttctactccaggattagggagctcaggcactactccgactccgtctatggcgacaccctcgagaagctcacaaacaccggcctctataatctcctcatcaggaggctgagatgccaaaagcccctcaaccctgctgagaaactgaggcacctgaatgagaagagaagatttcataacattgccggacactacagaggacagtgtcacagctgttgcaacagggctggcggaggaggaggcgacaccgaagagaaacccagaaccctccacgacctgtgtcaggctctcgagacaaccatccataacatcgagctccagtgtgtggaatgcaagaaacccctgcagaggtccgaggtgtatgatttcgccagagccgatctgacagtggtctatagggagggaaacccttttggcatctgcaaactgtgtctcaggtttctctccaagatcagcgagtatagacattataactacagcgtgtacggcaacaccctggagcaaaccgtgaaaaagcccctgaacgagatcctcattaggaggatcatttgtcagaggcccctctgtccccaggagaagaagagacatgtggacctgaataaaagattccataacatcagcggcagatgggccggcagatgtgccgcttgctggagatccagaggaggaggaggcggcgatcccaagcaaagaccctacaagctgcctgatctgtgcacagagctgaacacaagcctccaagatgtctccatcgcctgtgtctactgtaaggccacactggaaaggacagaggtgtaccagtttgccaggaaggatctctgcatcgtctacagggattgcatcgcttacgccgcttgtcacaaatgtatcgatttttattccagaatcagggaactgagatactatagcaactccgtctacggcgaaaccctcgagaaaattacaaacacagaactctacaacctgctgattaggaggctgagatgtcaaaagcctctcaaccccgccgagaaaagaaggcacctcaaagacaagaggagattccactccatcgctggccagtacagaggccagtgtaacacatgttgcgatcaggccggaggaggaggcggcgaccctgccacaagacccaggaccctccacgagctctgcgaggtgctggaggagtccgtgcacgagattaggctccagtgcgtgcagtgcaagaaggaactccaaaggagagaagtgtataaattcctgaggaccgacctcaggattgtctatagggacaacaacccctacggagtgtgcattatgtgcctgaggttcctcagcaagatttccgaatacaggcattatcagtacagcctctacggcaaaaccctcgaggagagggtcaaaaaacccctctccgaaatcaccatcagaaggatcatctgtcagacacctctctgccctgaggaaaaggaaaggcacgtgaacgctaacaagaggttccataatatcatgggcaggtggaccggaagatgcagcgagtgctggagacctagaggcggcggcggaggcgatgctgaagagaagcctaggaccctgcacgatctgtgtcaagccctggaaaccagcgtccacgaaatcgaactgaaatgtgtcgagtgcaaaaagaccctgcagaggagcgaagtctacgattttgtgagagccgacctgagaattgtctacagagacggaaaccccttcgccgtctgcaaggtctgcctcaggctgctctccaaaatcagcgaatataggcattacaattactccctctacggcgacacactggagcaaacactcaagaagtgcctcaacgagatcctgatcagaagaatcatctgccagaggcctctctgcccccaagagaagaagaggcacgtggatctgaacaaaaggtttcacaacatcagcggcaggtggaccggcagatgcgccgtgtgttggagacctagaggcggaggcggaggaaatcccgctgagaggcccagaaaactgcacgaactgtccagcgccctggagattccttacgacgaactgaggctcaactgcgtgtattgcaagggacaactcaccgagaccgaagtgctggacttcgccaggaccgatctcaccattgtctatagagacgacacccctcacggcgtgtgcaccaaatgcctcaggttctactccaaggtcagcgagtttaggtggtacagatactccgtgtacggcaccaccctcgaaaagctgaccaacaagggaatttgcgacctcctgattagaaggattacatgccagagacccctgtgccctgaggagaaacaaaggcacctggacaagaagaagagattccacaacatcggcggcagatggacaggcagatgcatcgcctgctggaggaggccttgatga

SEQ ID NO: 149 - DNA, 13512 bp, Artificial
  synthetic polynucleotide
ataggcggcgcatgagagaagcccagaccaattacctacccaaaatggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgatggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctcagaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgacatagtctagtccgccaagatggaaaccctgtgtcagaggctgaatgtgtgtcaagacaaaatcctgacccactacgagaatgactccacagacctgagggaccacatcgattactggaagcacatgaggctcgagtgcgccatctactataaggccagagagatgggctttaagcatatcaatcatcaagtcgtgcccacactggccgtgagcaagaacaaggccctgcaagctattgagctccaactgaccctcgagaccatctacaacagccagtacagcaacgagaaatggacactgcaggatgtgtccctcgaagtgtacctcacagcccctaccggatgtatcgccaagcacggctacacagtggaagtgcagtttgacggcgatatctgcaatacaatgcattacaccaactggacccacatctatatctgcgaggaagctagcgtcacagtggtggagggccaggtcgactattacggcctctattacgtgcatgagggcatcaggacctactttgtgcagtttaaggacgatgccgaaaaatacagcaaaaataaagtgtgggaagtccatgccggaggccaggtgatcctgtgtcccacctccgtctttagcggaggcaccggcggcagcacaacccctatcgtccacctgaaaggagatgccaacacactgaaatgtctcaggtacaggttcaagaagcactgtaccctgtatacagccgtcagcagcacatggcattggaccggccacaacgtcaagcataagagcgccatcgtgaccctcacatacgatagcgaatggcaaagggaccagttcctgagccaggtcaagatccccaagacaatcacagtgtccaccggctttatgtccatcggcggaggaggcggaatgcagacccctaaggagaccctcagcgaaagactcagctgcgtgcaggataaaatcattgaccattatgagaatgattccaaggacatcgatagccagattcaatactggcagctgatcaggtgggagaacgccatcttcttcgccgccagggagcacggcattcaaaccctcaaccatcaggtggtgcccgcttacaacatcagcaagagcaaagcccataaggccattgagctgcagatggccctccagggcctggctcagagcgcttataaaaccgaagactggaccctgcaagacacatgcgaggagctgtggaacaccgaacccacacactgcttcgccaaaggcggccaaacagtgcaggtgtacttcgatggcaacaaggacaattgcatgacctacgtcgcttgggactccgtctattacatgacagatgccggcacatgggacaagaccgccacatgcgtcagccacaggggactgtactacgtgaaagagggatacaataccttctacatcgagttcaaatccgagtgtgagaagtacggcaatacaggcacctgggaggtgcatttcggcaataatgtgattgactgcaacgatagcatgtgtagcggcggaaccggcggttctacaacccccatcatccacctgaagggcgaccgtaattctctgaagtgcctgaggtacagactcaggaagcacagcgaccattacagggatatctccagcacctggcactggacaggcgctggcaatgaaaagacaggaatcctcacagtgacctaccactccgagacccagaggacaaaattcctgaacaccgtggccatccccgacagcgtccagattctggtgggctatatgaccatgggaggaggcggaggcatggagacactcagccaaaggctcaacgtgtgccaggataagatcctggagcactacgagaacgacagcaaaaggctgtgtgatcatatcgactactggaagcatatcaggctggagtgcgtcctgatgtacaaggccagagaaatgggaatccattccatcaaccaccaagtggtccctgctctctccgtcagcaaagccaaggctctgcaggctattgaactgcaaatgatgctggagaccctcaacaacaccgagtacaaaaacgaggattggaccatgcaacagacctccctcgaactctatctgacagcccccacaggctgcctcgccaagcatggctacaccgtggaggtgcaattcgacggcgatgtccacaacacaatgcactacacaaactggaagttcatctacctctgcatcgacggacagtgtaccgtcgtggaaggacaagtgaactgcaagggcatctactacgtccacgagggccacattacctacttcgtgaacttcaccgaggaagccaagaaatacggcaccggaaagaagtgggaggtccacgccggcggccaagtcattgtgtttcctgaaagcgtcttcagcggaggcacaggcggctccaccacacccatcatccatctgaaaggcgatgccaacatcctcaaatgcctcaggtataggctgagcaaatacaaacaactgtacgaacaagtgtcctccacctggcattggacatgtaccgacggcaagcacaaaaacgccatcgtcaccctgacctacattagcaccagccagagagacgacttcctcaatacagtgaagatccctaacaccgtgagcgtgagcaccggctacatgacaattggaggcggcggcggcatggaagagatttccgccagactcaacgccgtgcaggagaaaatcctggacctctacgaggccgataaaaccgatctcccctcccagattgagcactggaagctgatcagaatggaatgcgccctgctctacaccgccaaacagatgggcttctcccacctctgccaccaggtcgtgccctccctcctggcttccaagaccaaggccttccaggtgatcgagctgcaaatggctctcgaaaccctgtccaagagccagtatagcacctcccaatggaccctgcagcaaacctccctggaagtctggctgtgtgaaccccccaaatgcttcgctaagcaaggcgagaccgtcacagtccagtacgacaatgataagaagaataccatggactataccaactggggcgagatctacattatcgaggaggatacctgcaccatggtgaccggcaaggtggactatattggaatgtactatatccataactgcgagaaagtctatttcaagtatttcaaagaggacgccgccaaatacagcaagacccagatgtgggaggtgcacgtcggaggacaggtgattgtctgtcctacctccatctcctccggcggaacaggcggaagcgtggcccctattgtccatctcaagggcgagagcaactccctgaagtgtctcaggtatagactgaagccctacaaggagctgtactccagcatgagctccacctggcactggaccagcgataacaagaacagcaagaacggcatcgtgacagtgacattcgtgacagaacagcagcagcagatgttcctcggcacagtgaaaattccccccaccgtgcaaattagcaccggcttcatgacactgtgatgaggcgcgcccacccagcggccgcatacagcagcaattggcaagctgcttacatagaactcgcggcgattggcatgccgccttaaaatttttattttatttttcttttcttttccgaatcggattttgtttttaatatttcaaaaaaaaaaaaaaaaaaaaaaaaaaaaaaaaaaaaaaaagaagagcgtttaaacacgtgatatctggcctcatgggccttcctttcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgaatacacggtgcctgactgcgttagcaatttaactgtgataaactaccgcattaaagcttatcgatgataagctgtcaaacatgagaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacacgcgtaatacgactcactatag

SEQ ID NO: 150 - RNA, 13512 nt, Artificial
  synthetic polynucleotide
auaggcggcgcaugagagaagcccagaccaauuaccuacccaaaauggagaaaguucacguugacaucgaggaagacagcccauuccucagagcuuugcagcggagcuucccgcaguuugagguagaagccaagcaggucacugauaaugaccaugcuaaugccagagcguuuucgcaucuggcuucaaaacugaucgaaacggagguggacccauccgacacgauccuugacauuggaagugcgcccgcccgcagaauguauucuaagcacaaguaucauuguaucuguccgaugagaugugcggaagauccggacagauuguauaaguaugcaacuaagcugaagaaaaacuguaaggaaauaacugauaaggaauuggacaagaaaaugaaggagcucgccgccgucaugagcgacccugaccuggaaacugagacuaugugccuccacgacgacgagucgugucgcuacgaagggcaagucgcuguuuaccaggauguauacgcgguugacggaccgacaagucucuaucaccaagccaauaagggaguuagagucgccuacuggauaggcuuugacaccaccccuuuuauguuuaagaacuuggcuggagcauauccaucauacucuaccaacugggccgacgaaaccguguuaacggcucguaacauaggccuaugcagcucugacguuauggagcggucacguagagggauguccauucuuagaaagaaguauuugaaaccauccaacaauguucuauucucuguuggcucgaccaucuaccacgagaagagggacuuacugaggagcuggcaccugccgucuguauuucacuuacguggcaagcaaaauuacacaugucggugugagacuauaguuaguugcgacggguacgucguuaaaagaauagcuaucaguccaggccuguaugggaagccuucaggcuaugcugcuacgaugcaccgcgagggauucuugugcugcaaagugacagacacauugaacggggagagggucucuuuucccgugugcacguaugugccagcuacauugugugaccaaaugacuggcauacuggcaacagaugucagugcggacgacgcgcaaaaacugcugguugggcucaaccagcguauagucgucaacggucgcacccagagaaacaccaauaccaugaaaaauuaccuuuugcccguaguggcccaggcauuugcuaggugggcaaaggaauauaaggaagaucaagaagaugaaaggccacuaggacuacgagauagacaguuagucaugggguguuguugggcuuuuagaaggcacaagauaacaucuauuuauaagcgcccggauacccaaaccaucaucaaagugaacagcgauuuccacucauucgugcugcccaggauaggcaguaacacauuggagaucgggcugagaacaagaaucaggaaaauguuagaggagcacaaggagccgucaccucucauuaccgccgaggacguacaagaagcuaagugcgcagccgaugaggcuaaggaggugcgugaagccgaggaguugcgcgcagcucuaccaccuuuggcagcugauguugaggagcccacucuggaagccgaugucgacuugauguuacaagaggcuggggccggcucaguggagacaccucguggcuugauaaagguuaccagcuacgauggcgaggacaagaucggcucuuacgcugugcuuucuccgcaggcuguacucaagagugaaaaauuaucuugcauccacccucucgcugaacaagucauagugauaacacacucuggccgaaaagggcguuaugccguggaaccauaccaugguaaaguaguggugccagagggacaugcaauacccguccaggacuuucaagcucugagugaaagugccaccauuguguacaacgaacgugaguucguaaacagguaccugcaccauauugccacacauggaggagcgcugaacacugaugaagaauauuacaaaacugucaagcccagcgagcacgacggcgaauaccuguacgacaucgacaggaaacagugcgucaagaaagaacuagucacugggcuagggcucacaggcgagcugguggauccucccuuccaugaauucgccuacgagagucugagaacacgaccagccgcuccuuaccaaguaccaaccauagggguguauggcgugccaggaucaggcaagucuggcaucauuaaaagcgcagucaccaaaaaagaucuaguggugagcgccaagaaagaaaacugugcagaaauuauaagggacgucaagaaaaugaaagggcuggacgucaaugccagaacuguggacucagugcucuugaauggaugcaaacaccccguagagacccuguauauugacgaagcuuuugcuugucaugcagguacucucagagcgcucauagccauuauaagaccuaaaaaggcagugcucugcggggaucccaaacagugcgguuuuuuuaacaugaugugccugaaagugcauuuuaaccacgagauuugcacacaagucuuccacaaaagcaucucucgccguugcacuaaaucugugacuucggucgucucaaccuuguuuuacgacaaaaaaaugagaacgacgaauccgaaagagacuaagauugugauugacacuaccggcaguaccaaaccuaagcaggacgaucucauucucacuuguuucagagggugggugaagcaguugcaaauagauuacaaaggcaacgaaauaaugacggcagcugccucucaagggcugacccguaaagguguguaugccguucgguacaaggugaaugaaaauccucuguacgcacccaccucagaacaugugaacguccuacugacccgcacggaggaccgcaucguguggaaaacacuagccggcgacccauggauaaaaacacugacugccaaguacccugggaauuucacugccacgauagaggaguggcaagcagagcaugaugccaucaugaggcacaucuuggagagaccggacccuaccgacgucuuccagaauaaggcaaacguguguugggccaaggcuuuagugccggugcugaagaccgcuggcauagacaugaccacugaacaauggaacacuguggauuauuuugaaacggacaaagcucacucagcagagauaguauugaaccaacuaugcgugagguucuuuggacucgaucuggacuccggucuauuuucugcacccacuguuccguuauccauuaggaauaaucacugggauaacuccccgucgccuaacauguacgggcugaauaaagaagugguccgucagcucucucgcagguacccacaacugccucgggcaguugccacuggaagagucuaugacaugaacacugguacacugcgcaauuaugauccgcgcauaaaccuaguaccuguaaacagaagacugccucaugcuuuaguccuccaccauaaugaacacccacagagugacuuuucuucauucgucagcaaauugaagggcagaacuguccugguggucggggaaaaguuguccgucccaggcaaaaugguugacugguugucagaccggccugaggcuaccuucagagcucggcuggauuuaggcaucccaggugaugugcccaaauaugacauaauauuuguuaaugugaggaccccauauaaauaccaucacuaucagcagugugaagaccaugccauuaagcuuagcauguugaccaagaaagcuugucugcaucugaaucccggcggaaccugugucagcauagguuaugguuacgcugacagggccagcgaaagcaucauuggugcuauagcgcggcaguucaaguuuucccggguaugcaaaccgaaauccucacuugaagagacggaaguucuguuuguauucauuggguacgaucgcaaggcccguacgcacaauccuuacaagcuuucaucaaccuugaccaacauuuauacagguuccagacuccacgaagccggaugugcacccucauaucauguggugcgaggggauauugccacggccaccgaaggagugauuauaaaugcugcuaacagcaaaggacaaccuggcggaggggugugcggagcgcuguauaagaaauucccggaaagcuucgauuuacagccgaucgaaguaggaaaagcgcgacuggucaaaggugcagcuaaacauaucauucaugccguaggaccaaacuucaacaaaguuucggagguugaaggugacaaacaguuggcagaggcuuaugaguccaucgcuaagauugucaacgauaacaauuacaagucaguagcgauuccacuguuguccaccggcaucuuuuccgggaacaaagaucgacuaacccaaucauugaaccauuugcugacagcuuuagacaccacugaugcagauguagccauauacugcagggacaagaaaugggaaaugacucucaaggaagcaguggcuaggagagaagcaguggaggagauaugcauauccgacgacucuucagugacagaaccugaugcagagcuggugagggugcauccgaagaguucuuuggcuggaaggaagggcuacagcacaagcgauggcaaaacuuucucauauuuggaagggaccaaguuucaccaggcggccaaggauauagcagaaauuaaugccauguggcccguugcaacggaggccaaugagcagguaugcauguauauccucggagaaagcaugagcaguauuaggucgaaaugccccgucgaagagucggaagccuccacaccaccuagcacgcugccuugcuugugcauccaugccaugacuccagaaagaguacagcgccuaaaagccucacguccagaacaaauuacugugugcucauccuuuccauugccgaaguauagaaucacuggugugcagaagauccaaugcucccagccuauauuguucucaccgaaagugccugcguauauucauccaaggaaguaucucguggaaacaccaccgguagacgagacuccggagccaucggcagagaaccaauccacagaggggacaccugaacaaccaccacuuauaaccgaggaugagaccaggacuagaacgccugagccgaucaucaucgaagaggaagaagaggauagcauaaguuugcugucagauggcccgacccaccaggugcugcaagucgaggcagacauucacgggccgcccucuguaucuagcucauccugguccauuccucaugcauccgacuuugauguggacaguuuauccauacuugacacccuggagggagcuagcgugaccagcggggcaacgucagccgagacuaacucuuacuucgcaaagaguauggaguuucuggcgcgaccggugccugcgccucgaacaguauucaggaacccuccacaucccgcuccgcgcacaagaacaccgucacuugcacccagcagggccugcucgagaaccagccuaguuuccaccccgccaggcgugaauagggugaucacuagagaggagcucgaggcgcuuaccccgucacgcacuccuagcaggucggucucgagaaccagccuggucuccaacccgccaggcguaaauagggugauuacaagagaggaguuugaggcguucguagcacaacaacaaugacgguuugaugcgggugcauacaucuuuuccuccgacaccggucaagggcauuuacaacaaaaaucaguaaggcaaacggugcuauccgaagugguguuggagaggaccgaauuggagauuucguaugccccgcgccucgaccaagaaaaagaagaauuacuacgcaagaaauuacaguuaaaucccacaccugcuaacagaagcagauaccaguccaggaagguggagaacaugaaagccauaacagcuagacguauucugcaaggccuagggcauuauuugaaggcagaaggaaaaguggagugcuaccgaacccugcauccuguuccuuuguauucaucuagugugaaccgugccuuuucaagccccaaggucgcaguggaagccuguaacgccauguugaaagagaacuuuccgacuguggcuucuuacuguauuauuccagaguacgaugccuauuuggacaugguugacggagcuucaugcugcuuagacacugccaguuuuugcccugcaaagcugcgcagcuuuccaaagaaacacuccuauuuggaacccacaauacgaucggcagugccuucagcgauccagaacacgcuccagaacguccuggcagcugccacaaaaagaaauugcaaugucacgcaaaugagagaauugcccguauuggauucggcggccuuuaauguggaaugcuucaagaaauaugcguguaauaaugaauauugggaaacguuuaaagaaaaccccaucaggcuuacugaagaaaacgugguaaauuacauuaccaaauuaaaaggaccaaaagcugcugcucuuuuugcgaagacacauaauuugaauauguugcaggacauaccaauggacagguuuguaauggacuuaaagagagacgugaaagugacuccaggaacaaaacauacugaagaacggcccaagguacaggugauccaggcugccgauccgcuagcaacagcguaucugugcggaauccaccgagagcugguuaggagauuaaaugcgguccugcuuccgaacauucauacacuguuugauaugucggcugaagacuuugacgcuauuauagccgagcacuuccagccuggggauuguguucuggaaacugacaucgcgucguuugauaaaagugaggacgacgccauggcucugaccgcguuaaugauucuggaagacuuagguguggacgcagagcuguugacgcugauugaggcggcuuucggcgaaauuucaucaauacauuugcccacuaaaacuaaauuuaaauucggagccaugaugaaaucuggaauguuccucacacuguuugugaacacagucauuaacauuguaaucgcaagcagaguguugagagaacggcuaaccggaucaccaugugcagcauucauuggagaugacaauaucgugaaaggagucaaaucggacaaauuaauggcagacaggugcgccaccugguugaauauggaagucaagauuauagaugcuguggugggcgagaaagcgccuuauuucuguggaggguuuauuuugugugacuccgugaccggcacagcgugccguguggcagacccccuaaaaaggcuguuuaagcuuggcaaaccucuggcagcagacgaugaacaugaugaugacaggagaagggcauugcaugaagagucaacacgcuggaaccgaguggguauucuuucagagcugugcaaggcaguagaaucaagguaugaaaccguaggaacuuccaucauaguuauggccaugacuacucuagcuagcaguguuaaaucauucagcuaccugagaggggccccuauaacucucuacggcuaaccugaauggacuacgacauagucuaguccgccaagauggaaacccugugucagaggcugaaugugugucaagacaaaauccugacccacuacgagaaugacuccacagaccugagggaccacaucgauuacuggaagcacaugaggcucgagugcgccaucuacuauaaggccagagagaugggcuuuaagcauaucaaucaucaagucgugcccacacuggccgugagcaagaacaaggcccugcaagcuauugagcuccaacugacccucgagaccaucuacaacagccaguacagcaacgagaaauggacacugcaggaugugucccucgaaguguaccucacagccccuaccggauguaucgccaagcacggcuacacaguggaagugcaguuugacggcgauaucugcaauacaaugcauuacaccaacuggacccacaucuauaucugcgaggaagcuagcgucacagugguggagggccaggucgacuauuacggccucuauuacgugcaugagggcaucaggaccuacuuugugcaguuuaaggacgaugccgaaaaauacagcaaaaauaaagugugggaaguccaugccggaggccaggugauccugugucccaccuccgucuuuagcggaggcaccggcggcagcacaaccccuaucguccaccugaaaggagaugccaacacacugaaaugucucagguacagguucaagaagcacuguacccuguauacagccgucagcagcacauggcauuggaccggccacaacgucaagcauaagagcgccaucgugacccucacauacgauagcgaauggcaaagggaccaguuccugagccaggucaagauccccaagacaaucacaguguccaccggcuuuauguccaucggcggaggaggcggaaugcagaccccuaaggagacccucagcgaaagacucagcugcgugcaggauaaaaucauugaccauuaugagaaugauuccaaggacaucgauagccagauucaauacuggcagcugaucaggugggagaacgccaucuucuucgccgccagggagcacggcauucaaacccucaaccaucagguggugcccgcuuacaacaucagcaagagcaaagcccauaaggccauugagcugcagauggcccuccagggccuggcucagagcgcuuauaaaaccgaagacuggacccugcaagacacaugcgaggagcuguggaacaccgaacccacacacugcuucgccaaaggcggccaaacagugcagguguacuucgauggcaacaaggacaauugcaugaccuacgucgcuugggacuccgucuauuacaugacagaugccggcacaugggacaagaccgccacaugcgucagccacaggggacuguacuacgugaaagagggauacaauaccuucuacaucgaguucaaauccgagugugagaaguacggcaauacaggcaccugggaggugcauuucggcaauaaugugauugacugcaacgauagcauguguagcggcggaaccggcgguucuacaacccccaucauccaccugaagggcgaccguaauucucugaagugccugagguacagacucaggaagcacagcgaccauuacagggauaucuccagcaccuggcacuggacaggcgcuggcaaugaaaagacaggaauccucacagugaccuaccacuccgagacccagaggacaaaauuccugaacaccguggccauccccgacagcguccagauucuggugggcuauaugaccaugggaggaggcggaggcauggagacacucagccaaaggcucaacgugugccaggauaagauccuggagcacuacgagaacgacagcaaaaggcugugugaucauaucgacuacuggaagcauaucaggcuggagugcguccugauguacaaggccagagaaaugggaauccauuccaucaaccaccaaguggucccugcucucuccgucagcaaagccaaggcucugcaggcuauugaacugcaaaugaugcuggagacccucaacaacaccgaguacaaaaacgaggauuggaccaugcaacagaccucccucgaacucuaucugacagcccccacaggcugccucgccaagcauggcuacaccguggaggugcaauucgacggcgauguccacaacacaaugcacuacacaaacuggaaguucaucuaccucugcaucgacggacaguguaccgucguggaaggacaagugaacugcaagggcaucuacuacguccacgagggccacauuaccuacuucgugaacuucaccgaggaagccaagaaauacggcaccggaaagaagugggagguccacgccggcggccaagucauuguguuuccugaaagcgucuucagcggaggcacaggcggcuccaccacacccaucauccaucugaaaggcgaugccaacauccucaaaugccucagguauaggcugagcaaauacaaacaacuguacgaacaaguguccuccaccuggcauuggacauguaccgacggcaagcacaaaaacgccaucgucacccugaccuacauuagcaccagccagagagacgacuuccucaauacagugaagaucccuaacaccgugagcgugagcaccggcuacaugacaauuggaggcggcggcggcauggaagagauuuccgccagacucaacgccgugcaggagaaaauccuggaccucuacgaggccgauaaaaccgaucuccccucccagauugagcacuggaagcugaucagaauggaaugcgcccugcucuacaccgccaaacagaugggcuucucccaccucugccaccaggucgugcccucccuccuggcuuccaagaccaaggccuuccaggugaucgagcugcaaauggcucucgaaacccuguccaagagccaguauagcaccucccaauggacccugcagcaaaccucccuggaagucuggcugugugaaccccccaaaugcuucgcuaagcaaggcgagaccgucacaguccaguacgacaaugauaagaagaauaccauggacuauaccaacuggggcgagaucuacauuaucgaggaggauaccugcaccauggugaccggcaagguggacuauauuggaauguacuauauccauaacugcgagaaagucuauuucaaguauuucaaagaggacgccgccaaauacagcaagacccagaugugggaggugcacgucggaggacaggugauugucuguccuaccuccaucuccuccggcggaacaggcggaagcguggccccuauuguccaucucaagggcgagagcaacucccugaagugucucagguauagacugaagcccuacaaggagcuguacuccagcaugagcuccaccuggcacuggaccagcgauaacaagaacagcaagaacggcaucgugacagugacauucgugacagaacagcagcagcagauguuccucggcacagugaaaauuccccccaccgugcaaauuagcaccggcuucaugacacugugaugaggcgcgcccacccagcggccgcauacagcagcaauuggcaagcugcuuacauagaacucgcggcgauuggcaugccgccuuaaaauuuuuauuuuauuuuucuuuucuuuuccgaaucggauuuuguuuuuaauauuucaaaaaaaaaaaaaaaaaaaaaaaaaaaaaaaaaaaaaaaagaagagcguuuaaacacgugauaucuggccucaugggccuuccuuucacugcccgcuuuccagucgggaaaccugucgugccagcugcauuaacauggucauagcuguuuccuugcguauugggcgcucuccgcuuccucgcucacugacucgcugcgcucggucguucggguaaagccuggggugccuaaugagcaaaaggccagcaaaaggccaggaaccguaaaaaggccgcguugcuggcguuuuuccauaggcuccgccccccugacgagcaucacaaaaaucgacgcucaagucagagguggcgaaacccgacaggacuauaaagauaccaggcguuucccccuggaagcucccucgugcgcucuccuguuccgacccugccgcuuaccggauaccuguccgccuuucucccuucgggaagcguggcgcuuucucauagcucacgcuguagguaucucaguucgguguaggucguucgcuccaagcugggcugugugcacgaaccccccguucagcccgaccgcugcgccuuauccgguaacuaucgucuugaguccaacccgguaagacacgacuuaucgccacuggcagcagccacugguaacaggauuagcagagcgagguauguaggcggugcuacagaguucuugaagugguggccuaacuacggcuacacuagaagaacaguauuugguaucugcgcucugcugaagccaguuaccuucggaaaaagaguugguagcucuugauccggcaaacaaaccaccgcugguagcggugguuuuuuuguuugcaagcagcagauuacgcgcagaaaaaaaggaucucaagaagauccuuugaucuuuucuacggggucugacgcucaguggaacgaaaacucacguuaagggauuuuggucaugaauacacggugccugacugcguuagcaauuuaacugugauaaacuaccgcauuaaagcuuaucgaugauaagcugucaaacaugagaauucuuagaaaaacucaucgagcaucaaaugaaacugcaauuuauucauaucaggauuaucaauaccauauuuuugaaaaagccguuucuguaaugaaggagaaaacucaccgaggcaguuccauaggauggcaagauccugguaucggucugcgauuccgacucguccaacaucaauacaaccuauuaauuuccccucgucaaaaauaagguuaucaagugagaaaucaccaugagugacgacugaauccggugagaauggcaaaagcuuaugcauuucuuuccagacuuguucaacaggccagccauuacgcucgucaucaaaaucacucgcaucaaccaaaccguuauucauucgugauugcgccugagcgagacgaaauacgcgaucgcuguuaaaaggacaauuacaaacaggaaucgaaugcaaccggcgcaggaacacugccagcgcaucaacaauauuuucaccugaaucaggauauucuucuaauaccuggaaugcuguuuucccggggaucgcaguggugaguaaccaugcaucaucaggaguacggauaaaaugcuugauggucggaagaggcauaaauuccgucagccaguuuagucugaccaucucaucuguaacaucauuggcaacgcuaccuuugccauguuucagaaacaacucuggcgcaucgggcuucccauacaaucgauagauugucgcaccugauugcccgacauuaucgcgagcccauuuauacccauauaaaucagcauccauguuggaauuuaaucgcggccucgagcaagacguuucccguugaauauggcucauaacaccccuuguauuacuguuuauguaagcagacaguuuuauuguucaugagcggauacauauuugaauguauuuagaaaaauaaacaaauagggguuccgcgcacauuuccccgaaaagugccaccuaaauuguaagcguuaauauuuuguuaaaauucgcguuaaauuuuuguuaaaucagcucauuuuuuaaccaauaggccgaaaucggcaaaaucccuuauaaaucaaaagaauagaccgagauaggguugaguggccgcuacagggcgcucccauucgccauucaggcugcgcaacuguugggaagggcguuucggugcgggccucuucgcuauuacgccagcuggcgaaagggggaugugcugcaaggcgauuaaguuggguaacgccaggguuuucccagucacacgcguaauacgacucacuauag

SEQ ID NO: 151 - DNA, 13137 bp, Artificial
  synthetic polynucleotide
ataggcggcgcatgagagaagcccagaccaattacctacccaaaatggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgatggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctcagaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgacatagtctagtccgccaagatgaagatgcagacccccaaagaatccctgtccgagaggctcagcgccctgcaggataagatcctcgaccactacgaaaacgactccaaggacatcaactcccagatctcctattggcagctcatcaggctggagaacgctatcctgttcacagccagagagcacggcattaccaagctgaaccatcaagtggtcccccctattaacatctccaaaagcaaggcccacaaggccatcgagctgcaaatggccctcaaaggcctggcccagtccaagtataacaacgaggagtggaccctgcaggatacatgcgaggagctgtggaacaccgagccctcccaatgtttcgccaagggcggcaagacagtgcatgtctatttcgatggcaataaagataactgcatgaactacgtggtgtgggacagcatttactacattaccgaaaccggcatttgggacaagaccgctgcttgcgtcagctattggggcgtgtactacattaaggatggcgataccacctactacgtccagttcaagtccgaatgcgagaaatatggcaattccaacacctgggaagtgcagtatggaggcaatgtgatcgactgcaacgactccatgtgttccggaggaacaggaggaagcacaacccccatcatccatctgaagggagataagaacagcctcaagtgcctgaggtacaggctgaggaaatacgctgaccactactccgaaatctcctccacatggcactggaccggctgcaataagaacaccggaatcctgaccgtgacctacaactccgaggtgcagaggaacaccttcctggatgtcgtgacaatccccaattccgtccagattagcgtcggctacatgacaatcggcggaggaggcggaatggaaagcattcccgccaggctgaatgctgtgcaggaaaaaatcctcgatctgtacgaagccgactccaacgacctgaacgcccagatcgaacactggaaactgaccaggatggaatgcgtcctgttttataaagccaaggagctcggcatcacccatatcggccaccaagtcgtccctcccatggccgtgtccaaggccaaggcctgtcaggctattgagctccagctggccctggaggccctcaataaaacccaatatagcacagacggctggaccctccagcaaaccagcctcgagatgtggagggccgaaccccagaaatactttgccaaacacggctatacaatcacagtgcagtacgataatgacaagaataataccatggactacacaaattggaaagagatctacctgctcggcgagtgtgagtgcaccatcgtcgagggccaggtggattactacggcctgtactactggtgtgatggcgaaaagatctattttgtgaagttctccaacgacgctaagcagtactgtgtcacaggcgtctgggaggtccacgtcggaggccaggtgatcgtctgccctgctagcgtgagcagcggcggaacaggaggctccaccgctcccattattcatctgaaaggcgaccccaattccctgaagtgtctgaggtatagagtcaagacccacaaaagcctctacgtgcagatcagcagcacatggcactggacctccaatgagtgtacaaataataaactgggaatcgtcacaatcacctacagcgatgagacccaaaggcagcagttcctcaaaaccgtcaagatccccaataccgtccaggtgatccaaggcgtcatgtccctcggcggaggaggaggaatggaagagatcagcgccaggctcagcgctgtgcaagacaaaattctggacatctacgaggctgacaagaacgatctcacatcccagatcgagcactggaagctcatcaggatggagtgcgccattatgtacaccgccaggcaaatgggcattagccacctgtgccaccaagtggtgccctccctcgtcgcctccaagaccaaagccttccaggtgatcgagctccaaatggccctggagaccctgaacgccagcccctacaagacagacgagtggacactgcagcagacctccctggaagtctggctgtccgagccccagaagtgctttgctaagaagggcatcaccgtgaccgtgcaatacgacaacgacaaggccaacaccatggattataccaactggagcgaaatctacatcatcgaggagaccacctgtaccctcgtggccggcgaggtcgactacgtgggcctgtattacatccacggaaatgagaaaacatactttaaatattttaaggaggacgccaaaaaatatagcaagacacaactgtgggaggtgcacgtcggcagcagggtgattgtgtgtcctaccagcatccctagcggaggcacaggaggctccgtgtcccctattgtccacctgaaaggcgatcctaattccctgaaatgcctgaggtataggctcaaacccttcaaggacctctactgcaacatgagctccacatggcattggacaagcgacgataagggcgataaggtgggcattgtgaccgtgacctacaccaccgaaacccagaggcaactgttcctcaacaccgtgaagatccctcctacagtccagatctccaccggcgtgatgtccctgggaggcggaggaggccgtgctcattataacatcgtgaccttctgttgcaaatgtgactccaccctgagactctgtgtccagtccacccacgtggacattagaaccctggaagacctgctcatgggcacactgggcattgtgtgtcccatctgctcccagaagcccaccctccatgagtacatgctggacctgcagcccgagaccacagacctgtacggctaccaacagctgggcggaggaggaggaagacacaccatgctgtgtatgtgctgcaagtgtgaggctaggatcaagctcgtggtcgagagcagcgccgatgacctcagagcctttcagcagctgtttctgaacaccctgagcttcgtgtgtccttggtgtgcctcccagcagaccctgcaagacatcgtcctgcatctggagccccagaacgaaattcccgtggacctgctgggccatcagcagctctccgactccgaggaggaaaacgacgagatcgattgatgaggcgcgcccacccagcggccgcatacagcagcaattggcaagctgcttacatagaactcgcggcgattggcatgccgccttaaaatttttattttatttttcttttcttttccgaatcggattttgtttttaatatttcaaaaaaaaaaaaaaaaaaaaaaaaaaaaaaaaaaaaaaaagaagagcgtttaaacacgtgatatctggcctcatgggccttcctttcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgaatacacggtgcctgactgcgttagcaatttaactgtgataaactaccgcattaaagcttatcgatgataagctgtcaaacatgagaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacacgcgtaatacgactcactatag

SEQ ID NO: 152 - RNA, 13137 nt, Artificial
  synthetic polynucleotide
auaggcggcgcaugagagaagcccagaccaauuaccuacccaaaauggagaaaguucacguugacaucgaggaagacagcccauuccucagagcuuugcagcggagcuucccgcaguuugagguagaagccaagcaggucacugauaaugaccaugcuaaugccagagcguuuucgcaucuggcuucaaaacugaucgaaacggagguggacccauccgacacgauccuugacauuggaagugcgcccgcccgcagaauguauucuaagcacaaguaucauuguaucuguccgaugagaugugcggaagauccggacagauuguauaaguaugcaacuaagcugaagaaaaacuguaaggaaauaacugauaaggaauuggacaagaaaaugaaggagcucgccgccgucaugagcgacccugaccuggaaacugagacuaugugccuccacgacgacgagucgugucgcuacgaagggcaagucgcuguuuaccaggauguauacgcgguugacggaccgacaagucucuaucaccaagccaauaagggaguuagagucgccuacuggauaggcuuugacaccaccccuuuuauguuuaagaacuuggcuggagcauauccaucauacucuaccaacugggccgacgaaaccguguuaacggcucguaacauaggccuaugcagcucugacguuauggagcggucacguagagggauguccauucuuagaaagaaguauuugaaaccauccaacaauguucuauucucuguuggcucgaccaucuaccacgagaagagggacuuacugaggagcuggcaccugccgucuguauuucacuuacguggcaagcaaaauuacacaugucggugugagacuauaguuaguugcgacggguacgucguuaaaagaauagcuaucaguccaggccuguaugggaagccuucaggcuaugcugcuacgaugcaccgcgagggauucuugugcugcaaagugacagacacauugaacggggagagggucucuuuucccgugugcacguaugugccagcuacauugugugaccaaaugacuggcauacuggcaacagaugucagugcggacgacgcgcaaaaacugcugguugggcucaaccagcguauagucgucaacggucgcacccagagaaacaccaauaccaugaaaaauuaccuuuugcccguaguggcccaggcauuugcuaggugggcaaaggaauauaaggaagaucaagaagaugaaaggccacuaggacuacgagauagacaguuagucaugggguguuguugggcuuuuagaaggcacaagauaacaucuauuuauaagcgcccggauacccaaaccaucaucaaagugaacagcgauuuccacucauucgugcugcccaggauaggcaguaacacauuggagaucgggcugagaacaagaaucaggaaaauguuagaggagcacaaggagccgucaccucucauuaccgccgaggacguacaagaagcuaagugcgcagccgaugaggcuaaggaggugcgugaagccgaggaguugcgcgcagcucuaccaccuuuggcagcugauguugaggagcccacucuggaagccgaugucgacuugauguuacaagaggcuggggccggcucaguggagacaccucguggcuugauaaagguuaccagcuacgauggcgaggacaagaucggcucuuacgcugugcuuucuccgcaggcuguacucaagagugaaaaauuaucuugcauccacccucucgcugaacaagucauagugauaacacacucuggccgaaaagggcguuaugccguggaaccauaccaugguaaaguaguggugccagagggacaugcaauacccguccaggacuuucaagcucugagugaaagugccaccauuguguacaacgaacgugaguucguaaacagguaccugcaccauauugccacacauggaggagcgcugaacacugaugaagaauauuacaaaacugucaagcccagcgagcacgacggcgaauaccuguacgacaucgacaggaaacagugcgucaagaaagaacuagucacugggcuagggcucacaggcgagcugguggauccucccuuccaugaauucgccuacgagagucugagaacacgaccagccgcuccuuaccaaguaccaaccauagggguguauggcgugccaggaucaggcaagucuggcaucauuaaaagcgcagucaccaaaaaagaucuaguggugagcgccaagaaagaaaacugugcagaaauuauaagggacgucaagaaaaugaaagggcuggacgucaaugccagaacuguggacucagugcucuugaauggaugcaaacaccccguagagacccuguauauugacgaagcuuuugcuugucaugcagguacucucagagcgcucauagccauuauaagaccuaaaaaggcagugcucugcggggaucccaaacagugcgguuuuuuuaacaugaugugccugaaagugcauuuuaaccacgagauuugcacacaagucuuccacaaaagcaucucucgccguugcacuaaaucugugacuucggucgucucaaccuuguuuuacgacaaaaaaaugagaacgacgaauccgaaagagacuaagauugugauugacacuaccggcaguaccaaaccuaagcaggacgaucucauucucacuuguuucagagggugggugaagcaguugcaaauagauuacaaaggcaacgaaauaaugacggcagcugccucucaagggcugacccguaaagguguguaugccguucgguacaaggugaaugaaaauccucuguacgcacccaccucagaacaugugaacguccuacugacccgcacggaggaccgcaucguguggaaaacacuagccggcgacccauggauaaaaacacugacugccaaguacccugggaauuucacugccacgauagaggaguggcaagcagagcaugaugccaucaugaggcacaucuuggagagaccggacccuaccgacgucuuccagaauaaggcaaacguguguugggccaaggcuuuagugccggugcugaagaccgcuggcauagacaugaccacugaacaauggaacacuguggauuauuuugaaacggacaaagcucacucagcagagauaguauugaaccaacuaugcgugagguucuuuggacucgaucuggacuccggucuauuuucugcacccacuguuccguuauccauuaggaauaaucacugggauaacuccccgucgccuaacauguacgggcugaauaaagaagugguccgucagcucucucgcagguacccacaacugccucgggcaguugccacuggaagagucuaugacaugaacacugguacacugcgcaauuaugauccgcgcauaaaccuaguaccuguaaacagaagacugccucaugcuuuaguccuccaccauaaugaacacccacagagugacuuuucuucauucgucagcaaauugaagggcagaacuguccugguggucggggaaaaguuguccgucccaggcaaaaugguugacugguugucagaccggccugaggcuaccuucagagcucggcuggauuuaggcaucccaggugaugugcccaaauaugacauaauauuuguuaaugugaggaccccauauaaauaccaucacuaucagcagugugaagaccaugccauuaagcuuagcauguugaccaagaaagcuugucugcaucugaaucccggcggaaccugugucagcauagguuaugguuacgcugacagggccagcgaaagcaucauuggugcuauagcgcggcaguucaaguuuucccggguaugcaaaccgaaauccucacuugaagagacggaaguucuguuuguauucauuggguacgaucgcaaggcccguacgcacaauccuuacaagcuuucaucaaccuugaccaacauuuauacagguuccagacuccacgaagccggaugugcacccucauaucauguggugcgaggggauauugccacggccaccgaaggagugauuauaaaugcugcuaacagcaaaggacaaccuggcggaggggugugcggagcgcuguauaagaaauucccggaaagcuucgauuuacagccgaucgaaguaggaaaagcgcgacuggucaaaggugcagcuaaacauaucauucaugccguaggaccaaacuucaacaaaguuucggagguugaaggugacaaacaguuggcagaggcuuaugaguccaucgcuaagauugucaacgauaacaauuacaagucaguagcgauuccacuguuguccaccggcaucuuuuccgggaacaaagaucgacuaacccaaucauugaaccauuugcugacagcuuuagacaccacugaugcagauguagccauauacugcagggacaagaaaugggaaaugacucucaaggaagcaguggcuaggagagaagcaguggaggagauaugcauauccgacgacucuucagugacagaaccugaugcagagcuggugagggugcauccgaagaguucuuuggcuggaaggaagggcuacagcacaagcgauggcaaaacuuucucauauuuggaagggaccaaguuucaccaggcggccaaggauauagcagaaauuaaugccauguggcccguugcaacggaggccaaugagcagguaugcauguauauccucggagaaagcaugagcaguauuaggucgaaaugccccgucgaagagucggaagccuccacaccaccuagcacgcugccuugcuugugcauccaugccaugacuccagaaagaguacagcgccuaaaagccucacguccagaacaaauuacugugugcucauccuuuccauugccgaaguauagaaucacuggugugcagaagauccaaugcucccagccuauauuguucucaccgaaagugccugcguauauucauccaaggaaguaucucguggaaacaccaccgguagacgagacuccggagccaucggcagagaaccaauccacagaggggacaccugaacaaccaccacuuauaaccgaggaugagaccaggacuagaacgccugagccgaucaucaucgaagaggaagaagaggauagcauaaguuugcugucagauggcccgacccaccaggugcugcaagucgaggcagacauucacgggccgcccucuguaucuagcucauccugguccauuccucaugcauccgacuuugauguggacaguuuauccauacuugacacccuggagggagcuagcgugaccagcggggcaacgucagccgagacuaacucuuacuucgcaaagaguauggaguuucuggcgcgaccggugccugcgccucgaacaguauucaggaacccuccacaucccgcuccgcgcacaagaacaccgucacuugcacccagcagggccugcucgagaaccagccuaguuuccaccccgccaggcgugaauagggugaucacuagagaggagcucgaggcgcuuaccccgucacgcacuccuagcaggucggucucgagaaccagccuggucuccaacccgccaggcguaaauagggugauuacaagagaggaguuugaggcguucguagcacaacaacaaugacgguuugaugcgggugcauacaucuuuuccuccgacaccggucaagggcauuuacaacaaaaaucaguaaggcaaacggugcuauccgaagugguguuggagaggaccgaauuggagauuucguaugccccgcgccucgaccaagaaaaagaagaauuacuacgcaagaaauuacaguuaaaucccacaccugcuaacagaagcagauaccaguccaggaagguggagaacaugaaagccauaacagcuagacguauucugcaaggccuagggcauuauuugaaggcagaaggaaaaguggagugcuaccgaacccugcauccuguuccuuuguauucaucuagugugaaccgugccuuuucaagccccaaggucgcaguggaagccuguaacgccauguugaaagagaacuuuccgacuguggcuucuuacuguauuauuccagaguacgaugccuauuuggacaugguugacggagcuucaugcugcuuagacacugccaguuuuugcccugcaaagcugcgcagcuuuccaaagaaacacuccuauuuggaacccacaauacgaucggcagugccuucagcgauccagaacacgcuccagaacguccuggcagcugccacaaaaagaaauugcaaugucacgcaaaugagagaauugcccguauuggauucggcggccuuuaauguggaaugcuucaagaaauaugcguguaauaaugaauauugggaaacguuuaaagaaaaccccaucaggcuuacugaagaaaacgugguaaauuacauuaccaaauuaaaaggaccaaaagcugcugcucuuuuugcgaagacacauaauuugaauauguugcaggacauaccaauggacagguuuguaauggacuuaaagagagacgugaaagugacuccaggaacaaaacauacugaagaacggcccaagguacaggugauccaggcugccgauccgcuagcaacagcguaucugugcggaauccaccgagagcugguuaggagauuaaaugcgguccugcuuccgaacauucauacacuguuugauaugucggcugaagacuuugacgcuauuauagccgagcacuuccagccuggggauuguguucuggaaacugacaucgcgucguuugauaaaagugaggacgacgccauggcucugaccgcguuaaugauucuggaagacuuagguguggacgcagagcuguugacgcugauugaggcggcuuucggcgaaauuucaucaauacauuugcccacuaaaacuaaauuuaaauucggagccaugaugaaaucuggaauguuccucacacuguuugugaacacagucauuaacauuguaaucgcaagcagaguguugagagaacggcuaaccggaucaccaugugcagcauucauuggagaugacaauaucgugaaaggagucaaaucggacaaauuaauggcagacaggugcgccaccugguugaauauggaagucaagauuauagaugcuguggugggcgagaaagcgccuuauuucuguggaggguuuauuuugugugacuccgugaccggcacagcgugccguguggcagacccccuaaaaaggcuguuuaagcuuggcaaaccucuggcagcagacgaugaacaugaugaugacaggagaagggcauugcaugaagagucaacacgcuggaaccgaguggguauucuuucagagcugugcaaggcaguagaaucaagguaugaaaccguaggaacuuccaucauaguuauggccaugacuacucuagcuagcaguguuaaaucauucagcuaccugagaggggccccuauaacucucuacggcuaaccugaauggacuacgacauagucuaguccgccaagaugaagaugcagacccccaaagaaucccuguccgagaggcucagcgcccugcaggauaagauccucgaccacuacgaaaacgacuccaaggacaucaacucccagaucuccuauuggcagcucaucaggcuggagaacgcuauccuguucacagccagagagcacggcauuaccaagcugaaccaucaagugguccccccuauuaacaucuccaaaagcaaggcccacaaggccaucgagcugcaaauggcccucaaaggccuggcccaguccaaguauaacaacgaggaguggacccugcaggauacaugcgaggagcuguggaacaccgagcccucccaauguuucgccaagggcggcaagacagugcaugucuauuucgauggcaauaaagauaacugcaugaacuacguggugugggacagcauuuacuacauuaccgaaaccggcauuugggacaagaccgcugcuugcgucagcuauuggggcguguacuacauuaaggauggcgauaccaccuacuacguccaguucaaguccgaaugcgagaaauauggcaauuccaacaccugggaagugcaguauggaggcaaugugaucgacugcaacgacuccauguguuccggaggaacaggaggaagcacaacccccaucauccaucugaagggagauaagaacagccucaagugccugagguacaggcugaggaaauacgcugaccacuacuccgaaaucuccuccacauggcacuggaccggcugcaauaagaacaccggaauccugaccgugaccuacaacuccgaggugcagaggaacaccuuccuggaugucgugacaauccccaauuccguccagauuagcgucggcuacaugacaaucggcggaggaggcggaauggaaagcauucccgccaggcugaaugcugugcaggaaaaaauccucgaucuguacgaagccgacuccaacgaccugaacgcccagaucgaacacuggaaacugaccaggauggaaugcguccuguuuuauaaagccaaggagcucggcaucacccauaucggccaccaagucgucccucccauggccguguccaaggccaaggccugucaggcuauugagcuccagcuggcccuggaggcccucaauaaaacccaauauagcacagacggcuggacccuccagcaaaccagccucgagauguggagggccgaaccccagaaauacuuugccaaacacggcuauacaaucacagugcaguacgauaaugacaagaauaauaccauggacuacacaaauuggaaagagaucuaccugcucggcgagugugagugcaccaucgucgagggccagguggauuacuacggccuguacuacuggugugauggcgaaaagaucuauuuugugaaguucuccaacgacgcuaagcaguacugugucacaggcgucugggagguccacgucggaggccaggugaucgucugcccugcuagcgugagcagcggcggaacaggaggcuccaccgcucccauuauucaucugaaaggcgaccccaauucccugaagugucugagguauagagucaagacccacaaaagccucuacgugcagaucagcagcacauggcacuggaccuccaaugaguguacaaauaauaaacugggaaucgucacaaucaccuacagcgaugagacccaaaggcagcaguuccucaaaaccgucaagauccccaauaccguccaggugauccaaggcgucaugucccucggcggaggaggaggaauggaagagaucagcgccaggcucagcgcugugcaagacaaaauucuggacaucuacgaggcugacaagaacgaucucacaucccagaucgagcacuggaagcucaucaggauggagugcgccauuauguacaccgccaggcaaaugggcauuagccaccugugccaccaaguggugcccucccucgucgccuccaagaccaaagccuuccaggugaucgagcuccaaauggcccuggagacccugaacgccagccccuacaagacagacgaguggacacugcagcagaccucccuggaagucuggcuguccgagccccagaagugcuuugcuaagaagggcaucaccgugaccgugcaauacgacaacgacaaggccaacaccauggauuauaccaacuggagcgaaaucuacaucaucgaggagaccaccuguacccucguggccggcgaggucgacuacgugggccuguauuacauccacggaaaugagaaaacauacuuuaaauauuuuaaggaggacgccaaaaaauauagcaagacacaacugugggaggugcacgucggcagcagggugauuguguguccuaccagcaucccuagcggaggcacaggaggcuccguguccccuauuguccaccugaaaggcgauccuaauucccugaaaugccugagguauaggcucaaacccuucaaggaccucuacugcaacaugagcuccacauggcauuggacaagcgacgauaagggcgauaaggugggcauugugaccgugaccuacaccaccgaaacccagaggcaacuguuccucaacaccgugaagaucccuccuacaguccagaucuccaccggcgugaugucccugggaggcggaggaggccgugcucauuauaacaucgugaccuucuguugcaaaugugacuccacccugagacucuguguccaguccacccacguggacauuagaacccuggaagaccugcucaugggcacacugggcauugugugucccaucugcucccagaagcccacccuccaugaguacaugcuggaccugcagcccgagaccacagaccuguacggcuaccaacagcugggcggaggaggaggaagacacaccaugcuguguaugugcugcaagugugaggcuaggaucaagcucguggucgagagcagcgccgaugaccucagagccuuucagcagcuguuucugaacacccugagcuucguguguccuuggugugccucccagcagacccugcaagacaucguccugcaucuggagccccagaacgaaauucccguggaccugcugggccaucagcagcucuccgacuccgaggaggaaaacgacgagaucgauugaugaggcgcgcccacccagcggccgcauacagcagcaauuggcaagcugcuuacauagaacucgcggcgauuggcaugccgccuuaaaauuuuuauuuuauuuuucuuuucuuuuccgaaucggauuuuguuuuuaauauuucaaaaaaaaaaaaaaaaaaaaaaaaaaaaaaaaaaaaaaaagaagagcguuuaaacacgugauaucuggccucaugggccuuccuuucacugcccgcuuuccagucgggaaaccugucgugccagcugcauuaacauggucauagcuguuuccuugcguauugggcgcucuccgcuuccucgcucacugacucgcugcgcucggucguucggguaaagccuggggugccuaaugagcaaaaggccagcaaaaggccaggaaccguaaaaaggccgcguugcuggcguuuuuccauaggcuccgccccccugacgagcaucacaaaaaucgacgcucaagucagagguggcgaaacccgacaggacuauaaagauaccaggcguuucccccuggaagcucccucgugcgcucuccuguuccgacccugccgcuuaccggauaccuguccgccuuucucccuucgggaagcguggcgcuuucucauagcucacgcuguagguaucucaguucgguguaggucguucgcuccaagcugggcugugugcacgaaccccccguucagcccgaccgcugcgccuuauccgguaacuaucgucuugaguccaacccgguaagacacgacuuaucgccacuggcagcagccacugguaacaggauuagcagagcgagguauguaggcggugcuacagaguucuugaagugguggccuaacuacggcuacacuagaagaacaguauuugguaucugcgcucugcugaagccaguuaccuucggaaaaagaguugguagcucuugauccggcaaacaaaccaccgcugguagcggugguuuuuuuguuugcaagcagcagauuacgcgcagaaaaaaaggaucucaagaagauccuuugaucuuuucuacggggucugacgcucaguggaacgaaaacucacguuaagggauuuuggucaugaauacacggugccugacugcguuagcaauuuaacugugauaaacuaccgcauuaaagcuuaucgaugauaagcugucaaacaugagaauucuuagaaaaacucaucgagcaucaaaugaaacugcaauuuauucauaucaggauuaucaauaccauauuuuugaaaaagccguuucuguaaugaaggagaaaacucaccgaggcaguuccauaggauggcaagauccugguaucggucugcgauuccgacucguccaacaucaauacaaccuauuaauuuccccucgucaaaaauaagguuaucaagugagaaaucaccaugagugacgacugaauccggugagaauggcaaaagcuuaugcauuucuuuccagacuuguucaacaggccagccauuacgcucgucaucaaaaucacucgcaucaaccaaaccguuauucauucgugauugcgccugagcgagacgaaauacgcgaucgcuguuaaaaggacaauuacaaacaggaaucgaaugcaaccggcgcaggaacacugccagcgcaucaacaauauuuucaccugaaucaggauauucuucuaauaccuggaaugcuguuuucccggggaucgcaguggugaguaaccaugcaucaucaggaguacggauaaaaugcuugauggucggaagaggcauaaauuccgucagccaguuuagucugaccaucucaucuguaacaucauuggcaacgcuaccuuugccauguuucagaaacaacucuggcgcaucgggcuucccauacaaucgauagauugucgcaccugauugcccgacauuaucgcgagcccauuuauacccauauaaaucagcauccauguuggaauuuaaucgcggccucgagcaagacguuucccguugaauauggcucauaacaccccuuguauuacuguuuauguaagcagacaguuuuauuguucaugagcggauacauauuugaauguauuuagaaaaauaaacaaauagggguuccgcgcacauuuccccgaaaagugccaccuaaauuguaagcguuaauauuuuguuaaaauucgcguuaaauuuuuguuaaaucagcucauuuuuuaaccaauaggccgaaaucggcaaaaucccuuauaaaucaaaagaauagaccgagauaggguugaguggccgcuacagggcgcucccauucgccauucaggcugcgcaacuguugggaagggcguuucggugcgggccucuucgcuauuacgccagcuggcgaaagggggaugugcugcaaggcgauuaaguuggguaacgccaggguuuucccagucacacgcguaauacgacucacuauag

SEQ ID NO: 153 - DNA, 15582 bp, Artificial
  synthetic polynucleotide
ataggcggcgcatgagagaagcccagaccaattacctacccaaaatggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgatggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctcagaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgacatagtctagtccgccaagatggctaaggccgccatgctcgctaagtttaaggaactgtacggcgtctccttttccgagctcgtgagacctttcaagtccaacaagtccacctgctgtgactggtgcattgctgccttcggcctgacaccctccatcgccgactccatcaagacactgctgcaacagtactgcctgtatctgcacatccagagcctggcttgcagctggggaatggtggtgctgctgctcgtcaggtacaagtgcggcaagaacagggaaaccattgagaagctgctgagcaagctgctgtgcgtcagccctatgtgcatgatgattgagccccctaagctcaggagcacagctgccgctctctattggtacaaaaccggaatctccaacatcagcgaggtgtacggcgacacccctgagtggattcaaaggcaaacagtgctccagcatagcttcaacgattgcaccttcgagctgagccaaatggtgcaatgggcctacgataacgacatcgtggatgatagcgagattgcttacaaatatgcccagctggccgacacaaacagcaacgcctccgctttcctgaagtccaacagccaagccaaaatcgtgaaggactgcgctaccatgtgtaggcactacaaaagagccgagaagaagcaaatgagcatgagccagtggatcaaatatagatgcgacagggtcgacgatggaggagattggaagcagatcgtcatgtttctcagataccagggcgtggaatttatgagctttctgaccgccctgaagagatttctccagggcatccctaaaaagaactgtattctgctgtatggcgctgccaacaccgacaaaagcctgttcggaatgagcctcatgaagtttctgcagggcagcgtgatctgtttcgtgaacagcaagagccatttctggctccagcccctcgctgacgccaagatcggaatgctggacgacgctaccgtcccttgctggaactacatcgatgataatctcagaaacgctctggatggcaacctggtgagcatggacgtcaagcacagacccctggtccaactgaaatgtccccctctcctcatcacaagcaacattaacgccggcaccgatagcaggtggccctatctccataacagactggtggtgtttaccttccccaacgaatttcccttcgacgaaaacggcaatcctgtgtacgagctcaacgacaaaaactggaagtccttcttcagcagaacatggtccagactgagcctcggaggaggaggaggaaaacaaggagccatgctcgccgtcttcaaggacacctacggcctcagctttaccgacctcgtcagaaactttaaatccgataaaaccacctgcacagattgggtgaccgccattttcggagtgaatcccaccattgccgaaggcttcaagacactgatccaacctttcatcctgtacgcccacattcagtgtctcgactgtaagtggggcgtgctgattctggccctgctgagatacaaatgcggcaagtccagactcacagtggccaagggcctctccacactgctgcatgtccccgagacctgcatgctgattcaacctcccaaactcaggagcagcgtggctgctctgtactggtataggacaggcatttccaacatttccgaggtcatgggagacacacctgaatggattcaaagactgaccatcatccagcacggcatcgatgactccaacttcgacctgagcgaaatggtccagtgggctttcgacaacgagctgaccgacgagtccgacatggccttcgagtacgctctcctcgctgactccaactccaatgctgctgcttttctcaagtccaactgccaggctaagtacctgaaagactgcgccaccatgtgcaagcattacaggcgtgctcaaaaaaggcagatgaatatgtcccaatggattagatttaggtgctccaagatcgatgagggaggcgactggagacccattgtgcagttcctcaggtaccagcagatcgagtttatcacatttctgggagctctgaagtccttcctgaagggcacccccaagaaaaactgtctggtgttctgcggccctgctaatacagataaaagctacttcggcatgtccttcatccactttatccagggcgctgtgatcagcttcgtgaatagcacatcccacttttggctggaacccctcacagacacaaaggtggccatgctggatgacgctacaacaacctgttggacctatttcgatacctacatgaggaacgctctcgacggcaaccctattagcattgatagaaaacacaaacctctgatccagctgaagtgccctcccatcctcctcacaaccaacattcaccccgccaaggacaatagatggccttacctcgagagcaggatcaccgtctttgagtttcctaacgccttcccctttgacaagaacggcaaccccgtgtatgaaatcaatgataaaaattggaaatgtttcttcgagaggacatggagcagactcgatctcggaggcggcggcggagatcctcaggaaaggcctaggaaactcccccagctgtgcaccgagctgcagaccaccattcacgacattatcctggagtgcgtctactgcaagcaacagctgctcagaagggaggtctatgattttgccagaagggatctgtgcattgtgtacagagacggcaatccttatgccgtctgcgataagtgcctgaaattctatagcaaaatctccgaatacagacactactgctacagcctgtatggaaccaccctcgagcagcagtacaataaacccctgtgcgatctgctcatcaggaggatcaactgtcaaaagcccctgtgtcccgaggaaaagcagagacacctggataagaaacagaggttccacaatatcaggggcagatggaccggcagatgcatgtcctgttgtaggtccagcggcggaggaggaggagaccctaccagaaggccctataagctgcctgacctctgcacagaactcaataccagcctgcaggatatcgagatcacatgtgtctattgcaagaccgtgctggaactgaccgaagtgttcgagtttgctaggaaagacctcttcgtcgtgtacagggacagcatcccccatgccgcctgccacaagtgtattgacttctactccaggattagggagctcaggcactactccgactccgtctatggcgacaccctcgagaagctcacaaacaccggcctctataatctcctcatcaggaggctgagatgccaaaagcccctcaaccctgctgagaaactgaggcacctgaatgagaagagaagatttcataacattgccggacactacagaggacagtgtcacagctgttgcaacagggctggcggaggaggaggcgacaccgaagagaaacccagaaccctccacgacctgtgtcaggctctcgagacaaccatccataacatcgagctccagtgtgtggaatgcaagaaacccctgcagaggtccgaggtgtatgatttcgccagagccgatctgacagtggtctatagggagggaaacccttttggcatctgcaaactgtgtctcaggtttctctccaagatcagcgagtatagacattataactacagcgtgtacggcaacaccctggagcaaaccgtgaaaaagcccctgaacgagatcctcattaggaggatcatttgtcagaggcccctctgtccccaggagaagaagagacatgtggacctgaataaaagattccataacatcagcggcagatgggccggcagatgtgccgcttgctggagatccagaggaggaggaggcggcgatcccaagcaaagaccctacaagctgcctgatctgtgcacagagctgaacacaagcctccaagatgtctccatcgcctgtgtctactgtaaggccacactggaaaggacagaggtgtaccagtttgccaggaaggatctctgcatcgtctacagggattgcatcgcttacgccgcttgtcacaaatgtatcgatttttattccagaatcagggaactgagatactatagcaactccgtctacggcgaaaccctcgagaaaattacaaacacagaactctacaacctgctgattaggaggctgagatgtcaaaagcctctcaaccccgccgagaaaagaaggcacctcaaagacaagaggagattccactccatcgctggccagtacagaggccagtgtaacacatgttgcgatcaggccggaggaggaggcggcgaccctgccacaagacccaggaccctccacgagctctgcgaggtgctggaggagtccgtgcacgagattaggctccagtgcgtgcagtgcaagaaggaactccaaaggagagaagtgtataaattcctgaggaccgacctcaggattgtctatagggacaacaacccctacggagtgtgcattatgtgcctgaggttcctcagcaagatttccgaatacaggcattatcagtacagcctctacggcaaaaccctcgaggagagggtcaaaaaacccctctccgaaatcaccatcagaaggatcatctgtcagacacctctctgccctgaggaaaaggaaaggcacgtgaacgctaacaagaggttccataatatcatgggcaggtggaccggaagatgcagcgagtgctggagacctagaggcggcggcggaggcgatgctgaagagaagcctaggaccctgcacgatctgtgtcaagccctggaaaccagcgtccacgaaatcgaactgaaatgtgtcgagtgcaaaaagaccctgcagaggagcgaagtctacgattttgtgagagccgacctgagaattgtctacagagacggaaaccccttcgccgtctgcaaggtctgcctcaggctgctctccaaaatcagcgaatataggcattacaattactccctctacggcgacacactggagcaaacactcaagaagtgcctcaacgagatcctgatcagaagaatcatctgccagaggcctctctgcccccaagagaagaagaggcacgtggatctgaacaaaaggtttcacaacatcagcggcaggtggaccggcagatgcgccgtgtgttggagacctagaggcggaggcggaggaaatcccgctgagaggcccagaaaactgcacgaactgtccagcgccctggagattccttacgacgaactgaggctcaactgcgtgtattgcaagggacaactcaccgagaccgaagtgctggacttcgccaggaccgatctcaccattgtctatagagacgacacccctcacggcgtgtgcaccaaatgcctcaggttctactccaaggtcagcgagtttaggtggtacagatactccgtgtacggcaccaccctcgaaaagctgaccaacaagggaatttgcgacctcctgattagaaggattacatgccagagacccctgtgccctgaggagaaacaaaggcacctggacaagaagaagagattccacaacatcggcggcagatggacaggcagatgcatcgcctgctggaggaggccttgatgaggcgcgcccacccagcggccgcatacagcagcaattggcaagctgcttacatagaactcgcggcgattggcatgccgccttaaaatttttattttatttttcttttcttttccgaatcggattttgtttttaatatttcaaaaaaaaaaaaaaaaaaaaaaaaaaaaaaaaaaaaaaaagaagagcgtttaaacacgtgatatctggcctcatgggccttcctttcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgaatacacggtgcctgactgcgttagcaatttaactgtgataaactaccgcattaaagcttatcgatgataagctgtcaaacatgagaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacacgcgtaatacgactcactatag

SEQ ID NO: 154 - RNA, 15582 nt, Artificial
  synthetic polynucleotide
auaggcggcgcaugagagaagcccagaccaauuaccuacccaaaauggagaaaguucacguugacaucgaggaagacagcccauuccucagagcuuugcagcggagcuucccgcaguuugagguagaagccaagcaggucacugauaaugaccaugcuaaugccagagcguuuucgcaucuggcuucaaaacugaucgaaacggagguggacccauccgacacgauccuugacauuggaagugcgcccgcccgcagaauguauucuaagcacaaguaucauuguaucuguccgaugagaugugcggaagauccggacagauuguauaaguaugcaacuaagcugaagaaaaacuguaaggaaauaacugauaaggaauuggacaagaaaaugaaggagcucgccgccgucaugagcgacccugaccuggaaacugagacuaugugccuccacgacgacgagucgugucgcuacgaagggcaagucgcuguuuaccaggauguauacgcgguugacggaccgacaagucucuaucaccaagccaauaagggaguuagagucgccuacuggauaggcuuugacaccaccccuuuuauguuuaagaacuuggcuggagcauauccaucauacucuaccaacugggccgacgaaaccguguuaacggcucguaacauaggccuaugcagcucugacguuauggagcggucacguagagggauguccauucuuagaaagaaguauuugaaaccauccaacaauguucuauucucuguuggcucgaccaucuaccacgagaagagggacuuacugaggagcuggcaccugccgucuguauuucacuuacguggcaagcaaaauuacacaugucggugugagacuauaguuaguugcgacggguacgucguuaaaagaauagcuaucaguccaggccuguaugggaagccuucaggcuaugcugcuacgaugcaccgcgagggauucuugugcugcaaagugacagacacauugaacggggagagggucucuuuucccgugugcacguaugugccagcuacauugugugaccaaaugacuggcauacuggcaacagaugucagugcggacgacgcgcaaaaacugcugguugggcucaaccagcguauagucgucaacggucgcacccagagaaacaccaauaccaugaaaaauuaccuuuugcccguaguggcccaggcauuugcuaggugggcaaaggaauauaaggaagaucaagaagaugaaaggccacuaggacuacgagauagacaguuagucaugggguguuguugggcuuuuagaaggcacaagauaacaucuauuuauaagcgcccggauacccaaaccaucaucaaagugaacagcgauuuccacucauucgugcugcccaggauaggcaguaacacauuggagaucgggcugagaacaagaaucaggaaaauguuagaggagcacaaggagccgucaccucucauuaccgccgaggacguacaagaagcuaagugcgcagccgaugaggcuaaggaggugcgugaagccgaggaguugcgcgcagcucuaccaccuuuggcagcugauguugaggagcccacucuggaagccgaugucgacuugauguuacaagaggcuggggccggcucaguggagacaccucguggcuugauaaagguuaccagcuacgauggcgaggacaagaucggcucuuacgcugugcuuucuccgcaggcuguacucaagagugaaaaauuaucuugcauccacccucucgcugaacaagucauagugauaacacacucuggccgaaaagggcguuaugccguggaaccauaccaugguaaaguaguggugccagagggacaugcaauacccguccaggacuuucaagcucugagugaaagugccaccauuguguacaacgaacgugaguucguaaacagguaccugcaccauauugccacacauggaggagcgcugaacacugaugaagaauauuacaaaacugucaagcccagcgagcacgacggcgaauaccuguacgacaucgacaggaaacagugcgucaagaaagaacuagucacugggcuagggcucacaggcgagcugguggauccucccuuccaugaauucgccuacgagagucugagaacacgaccagccgcuccuuaccaaguaccaaccauagggguguauggcgugccaggaucaggcaagucuggcaucauuaaaagcgcagucaccaaaaaagaucuaguggugagcgccaagaaagaaaacugugcagaaauuauaagggacgucaagaaaaugaaagggcuggacgucaaugccagaacuguggacucagugcucuugaauggaugcaaacaccccguagagacccuguauauugacgaagcuuuugcuugucaugcagguacucucagagcgcucauagccauuauaagaccuaaaaaggcagugcucugcggggaucccaaacagugcgguuuuuuuaacaugaugugccugaaagugcauuuuaaccacgagauuugcacacaagucuuccacaaaagcaucucucgccguugcacuaaaucugugacuucggucgucucaaccuuguuuuacgacaaaaaaaugagaacgacgaauccgaaagagacuaagauugugauugacacuaccggcaguaccaaaccuaagcaggacgaucucauucucacuuguuucagagggugggugaagcaguugcaaauagauuacaaaggcaacgaaauaaugacggcagcugccucucaagggcugacccguaaagguguguaugccguucgguacaaggugaaugaaaauccucuguacgcacccaccucagaacaugugaacguccuacugacccgcacggaggaccgcaucguguggaaaacacuagccggcgacccauggauaaaaacacugacugccaaguacccugggaauuucacugccacgauagaggaguggcaagcagagcaugaugccaucaugaggcacaucuuggagagaccggacccuaccgacgucuuccagaauaaggcaaacguguguugggccaaggcuuuagugccggugcugaagaccgcuggcauagacaugaccacugaacaauggaacacuguggauuauuuugaaacggacaaagcucacucagcagagauaguauugaaccaacuaugcgugagguucuuuggacucgaucuggacuccggucuauuuucugcacccacuguuccguuauccauuaggaauaaucacugggauaacuccccgucgccuaacauguacgggcugaauaaagaagugguccgucagcucucucgcagguacccacaacugccucgggcaguugccacuggaagagucuaugacaugaacacugguacacugcgcaauuaugauccgcgcauaaaccuaguaccuguaaacagaagacugccucaugcuuuaguccuccaccauaaugaacacccacagagugacuuuucuucauucgucagcaaauugaagggcagaacuguccugguggucggggaaaaguuguccgucccaggcaaaaugguugacugguugucagaccggccugaggcuaccuucagagcucggcuggauuuaggcaucccaggugaugugcccaaauaugacauaauauuuguuaaugugaggaccccauauaaauaccaucacuaucagcagugugaagaccaugccauuaagcuuagcauguugaccaagaaagcuugucugcaucugaaucccggcggaaccugugucagcauagguuaugguuacgcugacagggccagcgaaagcaucauuggugcuauagcgcggcaguucaaguuuucccggguaugcaaaccgaaauccucacuugaagagacggaaguucuguuuguauucauuggguacgaucgcaaggcccguacgcacaauccuuacaagcuuucaucaaccuugaccaacauuuauacagguuccagacuccacgaagccggaugugcacccucauaucauguggugcgaggggauauugccacggccaccgaaggagugauuauaaaugcugcuaacagcaaaggacaaccuggcggaggggugugcggagcgcuguauaagaaauucccggaaagcuucgauuuacagccgaucgaaguaggaaaagcgcgacuggucaaaggugcagcuaaacauaucauucaugccguaggaccaaacuucaacaaaguuucggagguugaaggugacaaacaguuggcagaggcuuaugaguccaucgcuaagauugucaacgauaacaauuacaagucaguagcgauuccacuguuguccaccggcaucuuuuccgggaacaaagaucgacuaacccaaucauugaaccauuugcugacagcuuuagacaccacugaugcagauguagccauauacugcagggacaagaaaugggaaaugacucucaaggaagcaguggcuaggagagaagcaguggaggagauaugcauauccgacgacucuucagugacagaaccugaugcagagcuggugagggugcauccgaagaguucuuuggcuggaaggaagggcuacagcacaagcgauggcaaaacuuucucauauuuggaagggaccaaguuucaccaggcggccaaggauauagcagaaauuaaugccauguggcccguugcaacggaggccaaugagcagguaugcauguauauccucggagaaagcaugagcaguauuaggucgaaaugccccgucgaagagucggaagccuccacaccaccuagcacgcugccuugcuugugcauccaugccaugacuccagaaagaguacagcgccuaaaagccucacguccagaacaaauuacugugugcucauccuuuccauugccgaaguauagaaucacuggugugcagaagauccaaugcucccagccuauauuguucucaccgaaagugccugcguauauucauccaaggaaguaucucguggaaacaccaccgguagacgagacuccggagccaucggcagagaaccaauccacagaggggacaccugaacaaccaccacuuauaaccgaggaugagaccaggacuagaacgccugagccgaucaucaucgaagaggaagaagaggauagcauaaguuugcugucagauggcccgacccaccaggugcugcaagucgaggcagacauucacgggccgcccucuguaucuagcucauccugguccauuccucaugcauccgacuuugauguggacaguuuauccauacuugacacccuggagggagcuagcgugaccagcggggcaacgucagccgagacuaacucuuacuucgcaaagaguauggaguuucuggcgcgaccggugccugcgccucgaacaguauucaggaacccuccacaucccgcuccgcgcacaagaacaccgucacuugcacccagcagggccugcucgagaaccagccuaguuuccaccccgccaggcgugaauagggugaucacuagagaggagcucgaggcgcuuaccccgucacgcacuccuagcaggucggucucgagaaccagccuggucuccaacccgccaggcguaaauagggugauuacaagagaggaguuugaggcguucguagcacaacaacaaugacgguuugaugcgggugcauacaucuuuuccuccgacaccggucaagggcauuuacaacaaaaaucaguaaggcaaacggugcuauccgaagugguguuggagaggaccgaauuggagauuucguaugccccgcgccucgaccaagaaaaagaagaauuacuacgcaagaaauuacaguuaaaucccacaccugcuaacagaagcagauaccaguccaggaagguggagaacaugaaagccauaacagcuagacguauucugcaaggccuagggcauuauuugaaggcagaaggaaaaguggagugcuaccgaacccugcauccuguuccuuuguauucaucuagugugaaccgugccuuuucaagccccaaggucgcaguggaagccuguaacgccauguugaaagagaacuuuccgacuguggcuucuuacuguauuauuccagaguacgaugccuauuuggacaugguugacggagcuucaugcugcuuagacacugccaguuuuugcccugcaaagcugcgcagcuuuccaaagaaacacuccuauuuggaacccacaauacgaucggcagugccuucagcgauccagaacacgcuccagaacguccuggcagcugccacaaaaagaaauugcaaugucacgcaaaugagagaauugcccguauuggauucggcggccuuuaauguggaaugcuucaagaaauaugcguguaauaaugaauauugggaaacguuuaaagaaaaccccaucaggcuuacugaagaaaacgugguaaauuacauuaccaaauuaaaaggaccaaaagcugcugcucuuuuugcgaagacacauaauuugaauauguugcaggacauaccaauggacagguuuguaauggacuuaaagagagacgugaaagugacuccaggaacaaaacauacugaagaacggcccaagguacaggugauccaggcugccgauccgcuagcaacagcguaucugugcggaauccaccgagagcugguuaggagauuaaaugcgguccugcuuccgaacauucauacacuguuugauaugucggcugaagacuuugacgcuauuauagccgagcacuuccagccuggggauuguguucuggaaacugacaucgcgucguuugauaaaagugaggacgacgccauggcucugaccgcguuaaugauucuggaagacuuagguguggacgcagagcuguugacgcugauugaggcggcuuucggcgaaauuucaucaauacauuugcccacuaaaacuaaauuuaaauucggagccaugaugaaaucuggaauguuccucacacuguuugugaacacagucauuaacauuguaaucgcaagcagaguguugagagaacggcuaaccggaucaccaugugcagcauucauuggagaugacaauaucgugaaaggagucaaaucggacaaauuaauggcagacaggugcgccaccugguugaauauggaagucaagauuauagaugcuguggugggcgagaaagcgccuuauuucuguggaggguuuauuuugugugacuccgugaccggcacagcgugccguguggcagacccccuaaaaaggcuguuuaagcuuggcaaaccucuggcagcagacgaugaacaugaugaugacaggagaagggcauugcaugaagagucaacacgcuggaaccgaguggguauucuuucagagcugugcaaggcaguagaaucaagguaugaaaccguaggaacuuccaucauaguuauggccaugacuacucuagcuagcaguguuaaaucauucagcuaccugagaggggccccuauaacucucuacggcuaaccugaauggacuacgacauagucuaguccgccaagauggcuaaggccgccaugcucgcuaaguuuaaggaacuguacggcgucuccuuuuccgagcucgugagaccuuucaaguccaacaaguccaccugcugugacuggugcauugcugccuucggccugacacccuccaucgccgacuccaucaagacacugcugcaacaguacugccuguaucugcacauccagagccuggcuugcagcuggggaaugguggugcugcugcucgucagguacaagugcggcaagaacagggaaaccauugagaagcugcugagcaagcugcugugcgucagcccuaugugcaugaugauugagcccccuaagcucaggagcacagcugccgcucucuauugguacaaaaccggaaucuccaacaucagcgagguguacggcgacaccccugaguggauucaaaggcaaacagugcuccagcauagcuucaacgauugcaccuucgagcugagccaaauggugcaaugggccuacgauaacgacaucguggaugauagcgagauugcuuacaaauaugcccagcuggccgacacaaacagcaacgccuccgcuuuccugaaguccaacagccaagccaaaaucgugaaggacugcgcuaccauguguaggcacuacaaaagagccgagaagaagcaaaugagcaugagccaguggaucaaauauagaugcgacagggucgacgauggaggagauuggaagcagaucgucauguuucucagauaccagggcguggaauuuaugagcuuucugaccgcccugaagagauuucuccagggcaucccuaaaaagaacuguauucugcuguauggcgcugccaacaccgacaaaagccuguucggaaugagccucaugaaguuucugcagggcagcgugaucuguuucgugaacagcaagagccauuucuggcuccagccccucgcugacgccaagaucggaaugcuggacgacgcuaccgucccuugcuggaacuacaucgaugauaaucucagaaacgcucuggauggcaaccuggugagcauggacgucaagcacagaccccugguccaacugaaaugucccccucuccucaucacaagcaacauuaacgccggcaccgauagcagguggcccuaucuccauaacagacuggugguguuuaccuuccccaacgaauuucccuucgacgaaaacggcaauccuguguacgagcucaacgacaaaaacuggaaguccuucuucagcagaacaugguccagacugagccucggaggaggaggaggaaaacaaggagccaugcucgccgucuucaaggacaccuacggccucagcuuuaccgaccucgucagaaacuuuaaauccgauaaaaccaccugcacagauugggugaccgccauuuucggagugaaucccaccauugccgaaggcuucaagacacugauccaaccuuucauccuguacgcccacauucagugucucgacuguaaguggggcgugcugauucuggcccugcugagauacaaaugcggcaaguccagacucacaguggccaagggccucuccacacugcugcauguccccgagaccugcaugcugauucaaccucccaaacucaggagcagcguggcugcucuguacugguauaggacaggcauuuccaacauuuccgaggucaugggagacacaccugaauggauucaaagacugaccaucauccagcacggcaucgaugacuccaacuucgaccugagcgaaaugguccagugggcuuucgacaacgagcugaccgacgaguccgacauggccuucgaguacgcucuccucgcugacuccaacuccaaugcugcugcuuuucucaaguccaacugccaggcuaaguaccugaaagacugcgccaccaugugcaagcauuacaggcgugcucaaaaaaggcagaugaauaugucccaauggauuagauuuaggugcuccaagaucgaugagggaggcgacuggagacccauugugcaguuccucagguaccagcagaucgaguuuaucacauuucugggagcucugaaguccuuccugaagggcacccccaagaaaaacugucugguguucugcggcccugcuaauacagauaaaagcuacuucggcauguccuucauccacuuuauccagggcgcugugaucagcuucgugaauagcacaucccacuuuuggcuggaaccccucacagacacaaagguggccaugcuggaugacgcuacaacaaccuguuggaccuauuucgauaccuacaugaggaacgcucucgacggcaacccuauuagcauugauagaaaacacaaaccucugauccagcugaagugcccucccauccuccucacaaccaacauucaccccgccaaggacaauagauggccuuaccucgagagcaggaucaccgucuuugaguuuccuaacgccuuccccuuugacaagaacggcaaccccguguaugaaaucaaugauaaaaauuggaaauguuucuucgagaggacauggagcagacucgaucucggaggcggcggcggagauccucaggaaaggccuaggaaacucccccagcugugcaccgagcugcagaccaccauucacgacauuauccuggagugcgucuacugcaagcaacagcugcucagaagggaggucuaugauuuugccagaagggaucugugcauuguguacagagacggcaauccuuaugccgucugcgauaagugccugaaauucuauagcaaaaucuccgaauacagacacuacugcuacagccuguauggaaccacccucgagcagcaguacaauaaaccccugugcgaucugcucaucaggaggaucaacugucaaaagccccugugucccgaggaaaagcagagacaccuggauaagaaacagagguuccacaauaucaggggcagauggaccggcagaugcauguccuguuguagguccagcggcggaggaggaggagacccuaccagaaggcccuauaagcugccugaccucugcacagaacucaauaccagccugcaggauaucgagaucacaugugucuauugcaagaccgugcuggaacugaccgaaguguucgaguuugcuaggaaagaccucuucgucguguacagggacagcaucccccaugccgccugccacaaguguauugacuucuacuccaggauuagggagcucaggcacuacuccgacuccgucuauggcgacacccucgagaagcucacaaacaccggccucuauaaucuccucaucaggaggcugagaugccaaaagccccucaacccugcugagaaacugaggcaccugaaugagaagagaagauuucauaacauugccggacacuacagaggacagugucacagcuguugcaacagggcuggcggaggaggaggcgacaccgaagagaaacccagaacccuccacgaccugugucaggcucucgagacaaccauccauaacaucgagcuccaguguguggaaugcaagaaaccccugcagagguccgagguguaugauuucgccagagccgaucugacaguggucuauagggagggaaacccuuuuggcaucugcaaacugugucucagguuucucuccaagaucagcgaguauagacauuauaacuacagcguguacggcaacacccuggagcaaaccgugaaaaagccccugaacgagauccucauuaggaggaucauuugucagaggccccucuguccccaggagaagaagagacauguggaccugaauaaaagauuccauaacaucagcggcagaugggccggcagaugugccgcuugcuggagauccagaggaggaggaggcggcgaucccaagcaaagacccuacaagcugccugaucugugcacagagcugaacacaagccuccaagaugucuccaucgccugugucuacuguaaggccacacuggaaaggacagagguguaccaguuugccaggaaggaucucugcaucgucuacagggauugcaucgcuuacgccgcuugucacaaauguaucgauuuuuauuccagaaucagggaacugagauacuauagcaacuccgucuacggcgaaacccucgagaaaauuacaaacacagaacucuacaaccugcugauuaggaggcugagaugucaaaagccucucaaccccgccgagaaaagaaggcaccucaaagacaagaggagauuccacuccaucgcuggccaguacagaggccaguguaacacauguugcgaucaggccggaggaggaggcggcgacccugccacaagacccaggacccuccacgagcucugcgaggugcuggaggaguccgugcacgagauuaggcuccagugcgugcagugcaagaaggaacuccaaaggagagaaguguauaaauuccugaggaccgaccucaggauugucuauagggacaacaaccccuacggagugugcauuaugugccugagguuccucagcaagauuuccgaauacaggcauuaucaguacagccucuacggcaaaacccucgaggagagggucaaaaaaccccucuccgaaaucaccaucagaaggaucaucugucagacaccucucugcccugaggaaaaggaaaggcacgugaacgcuaacaagagguuccauaauaucaugggcagguggaccggaagaugcagcgagugcuggagaccuagaggcggcggcggaggcgaugcugaagagaagccuaggacccugcacgaucugugucaagcccuggaaaccagcguccacgaaaucgaacugaaaugugucgagugcaaaaagacccugcagaggagcgaagucuacgauuuugugagagccgaccugagaauugucuacagagacggaaaccccuucgccgucugcaaggucugccucaggcugcucuccaaaaucagcgaauauaggcauuacaauuacucccucuacggcgacacacuggagcaaacacucaagaagugccucaacgagauccugaucagaagaaucaucugccagaggccucucugcccccaagagaagaagaggcacguggaucugaacaaaagguuucacaacaucagcggcagguggaccggcagaugcgccguguguuggagaccuagaggcggaggcggaggaaaucccgcugagaggcccagaaaacugcacgaacuguccagcgcccuggagauuccuuacgacgaacugaggcucaacugcguguauugcaagggacaacucaccgagaccgaagugcuggacuucgccaggaccgaucucaccauugucuauagagacgacaccccucacggcgugugcaccaaaugccucagguucuacuccaaggucagcgaguuuaggugguacagauacuccguguacggcaccacccucgaaaagcugaccaacaagggaauuugcgaccuccugauuagaaggauuacaugccagagaccccugugcccugaggagaaacaaaggcaccuggacaagaagaagagauuccacaacaucggcggcagauggacaggcagaugcaucgccugcuggaggaggccuugaugaggcgcgcccacccagcggccgcauacagcagcaauuggcaagcugcuuacauagaacucgcggcgauuggcaugccgccuuaaaauuuuuauuuuauuuuucuuuucuuuuccgaaucggauuuuguuuuuaauauuucaaaaaaaaaaaaaaaaaaaaaaaaaaaaaaaaaaaaaaaagaagagcguuuaaacacgugauaucuggccucaugggccuuccuuucacugcccgcuuuccagucgggaaaccugucgugccagcugcauuaacauggucauagcuguuuccuugcguauugggcgcucuccgcuuccucgcucacugacucgcugcgcucggucguucggguaaagccuggggugccuaaugagcaaaaggccagcaaaaggccaggaaccguaaaaaggccgcguugcuggcguuuuuccauaggcuccgccccccugacgagcaucacaaaaaucgacgcucaagucagagguggcgaaacccgacaggacuauaaagauaccaggcguuucccccuggaagcucccucgugcgcucuccuguuccgacccugccgcuuaccggauaccuguccgccuuucucccuucgggaagcguggcgcuuucucauagcucacgcuguagguaucucaguucgguguaggucguucgcuccaagcugggcugugugcacgaaccccccguucagcccgaccgcugcgccuuauccgguaacuaucgucuugaguccaacccgguaagacacgacuuaucgccacuggcagcagccacugguaacaggauuagcagagcgagguauguaggcggugcuacagaguucuugaagugguggccuaacuacggcuacacuagaagaacaguauuugguaucugcgcucugcugaagccaguuaccuucggaaaaagaguugguagcucuugauccggcaaacaaaccaccgcugguagcggugguuuuuuuguuugcaagcagcagauuacgcgcagaaaaaaaggaucucaagaagauccuuugaucuuuucuacggggucugacgcucaguggaacgaaaacucacguuaagggauuuuggucaugaauacacggugccugacugcguuagcaauuuaacugugauaaacuaccgcauuaaagcuuaucgaugauaagcugucaaacaugagaauucuuagaaaaacucaucgagcaucaaaugaaacugcaauuuauucauaucaggauuaucaauaccauauuuuugaaaaagccguuucuguaaugaaggagaaaacucaccgaggcaguuccauaggauggcaagauccugguaucggucugcgauuccgacucguccaacaucaauacaaccuauuaauuuccccucgucaaaaauaagguuaucaagugagaaaucaccaugagugacgacugaauccggugagaauggcaaaagcuuaugcauuucuuuccagacuuguucaacaggccagccauuacgcucgucaucaaaaucacucgcaucaaccaaaccguuauucauucgugauugcgccugagcgagacgaaauacgcgaucgcuguuaaaaggacaauuacaaacaggaaucgaaugcaaccggcgcaggaacacugccagcgcaucaacaauauuuucaccugaaucaggauauucuucuaauaccuggaaugcuguuuucccggggaucgcaguggugaguaaccaugcaucaucaggaguacggauaaaaugcuugauggucggaagaggcauaaauuccgucagccaguuuagucugaccaucucaucuguaacaucauuggcaacgcuaccuuugccauguuucagaaacaacucuggcgcaucgggcuucccauacaaucgauagauugucgcaccugauugcccgacauuaucgcgagcccauuuauacccauauaaaucagcauccauguuggaauuuaaucgcggccucgagcaagacguuucccguugaauauggcucauaacaccccuuguauuacuguuuauguaagcagacaguuuuauuguucaugagcggauacauauuugaauguauuuagaaaaauaaacaaauagggguuccgcgcacauuuccccgaaaagugccaccuaaauuguaagcguuaauauuuuguuaaaauucgcguuaaauuuuuguuaaaucagcucauuuuuuaaccaauaggccgaaaucggcaaaaucccuuauaaaucaaaagaauagaccgagauaggguugaguggccgcuacagggcgcucccauucgccauucaggcugcgcaacuguugggaagggcguuucggugcgggccucuucgcuauuacgccagcuggcgaaagggggaugugcugcaaggcgauuaaguuggguaacgccaggguuuucccagucacacgcguaauacgacucacuauag

What is claimed is:

1. A recombinant vector comprising nucleic acid sequences encoding:
   (a) antigenic Human Papillomavirus (HPV) polypeptides being fragments of a first HPV early protein, wherein said antigenic HPV polypeptides are from E1 of at least two different high-risk HPV types and share at least 70% amino acid sequence identity with corresponding region of E1 of at least one additional high-risk HPV type,
   (b) antigenic HPV polypeptides being fragments of a second HPV early protein, wherein said antigenic HPV polypeptides are from E2 of at least two different high-risk HPV types and share at least 70% amino acid sequence identity with corresponding region of E2 of at least one additional high-risk HPV type, and
   (c) antigenic HPV polypeptides being fragments of a third HPV early protein, wherein said antigenic HPV polypeptides are from E6 of at least two different high-risk HPV types and share at least 70% amino acid sequence identity with corresponding region of E6 of at least one additional high-risk HPV type,
wherein each of said antigenic HPV polypeptides includes at least one T cell epitope, and said nucleic acid sequences are operatively linked to one or more sequences which direct expression of said antigenic HPV polypeptides in a mammalian host cell.

2. The recombinant vector according to claim 1, wherein said recombinant vector does not comprise any nucleic acid sequence encoding an antigenic polypeptide from an HPV Late 1 (L1) protein or an HPV Late 2 (L2) protein.

3. The recombinant vector according to claim 1, wherein the nucleic acid sequences express separate antigenic HPV polypeptides.

4. The recombinant vector according to claim 1, wherein the nucleic acid sequences express antigenic HPV polypeptides that are linked by a peptide linker.

5. The recombinant vector according to claim 1, comprising antigenic polypeptide sequences selected from HPV types HPV16, HPV18, HPV31, HPV33, HPV35, HPV39, HPV45, HPV51, HPV52, HPV56, HPV58, HPV59, HPV68, HPV73 and HPV82.

6. The recombinant vector according to claim 1, comprising nucleic acid sequences encoding antigenic polypeptides from HPV16 E1, HPV18 E1, HPV16 E2, HPV18 E2, HPV16 E6 and HPV18 E6.

7. The recombinant vector according to claim 1, further comprising a nucleic acid sequence encoding antigenic HPV polypeptides being fragments of a fourth HPV early protein, wherein said antigenic HPV polypeptides are from E7 of at least two different high-risk HPV types and share at least 70% amino acid sequence identity with corresponding region of E7 of at least one additional high-risk HPV type, and each antigenic HPV polypeptide includes at least one T cell epitope, and wherein said fourth HPV early protein is E7.

8. The recombinant vector according to claim 1, comprising a nucleic acid sequence encoding a polypeptide having at least 90% sequence identity to a sequence selected from the group consisting of SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:89, SEQ ID NO:90, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112 and SEQ ID NO:113.

9. The recombinant vector according to claim 1, wherein said recombinant vector is an adenovirus vector capable of infecting mammalian epithelial cells.

10. The recombinant vector according to claim 9, wherein said recombinant vector is a non-human primate adenovirus vector.

11. An immunogenic composition comprising a recombinant vector according to claim 1 and a pharmaceutically acceptable carrier.

12. The immunogenic composition according to claim 11, further comprising an adjuvant.

13. An immunogenic composition comprising two or more recombinant vector(s) according to claim 1 and a pharmaceutically acceptable carrier.

14. The immunogenic composition of claim 11, further comprising at least one isolated antigenic HPV polypeptide from HPV E1, E2, E6 or E7, from a high-risk HPV type.

15. A method of inducing an immune response in a mammalian subject comprising administering to the mammalian subject a recombinant vector according to claim 1.

16. The recombinant vector according to claim 1, wherein said antigenic HPV polypeptides comprise at least about 60 amino acids in length.

17. The recombinant vector according to claim 1, wherein: said antigenic HPV polypeptides from E1 correspond to amino acids 203-622 of HPV16 E1 (SEQ ID NO: 39), said antigenic HPV polypeptides from E2 correspond to amino acids 1-201 and/or 285-365 of HPV16 E2 (SEQ ID NO: 40), or said antigenic HPV polypeptides from E6 correspond to amino acids 8-147 and/or 11-150 of HPV16 E6 (SEQ ID NO: 41).

18. The recombinant vector according to claim 1 that comprises a first vector and a second vector, wherein said first vector comprises a nucleic acid sequence encoding said antigenic HPV polypeptides from E1 and said antigenic HPV polypeptides from E2, and wherein said second vector comprises a nucleic acid sequence encoding said antigenic HPV polypeptides from E6.

19. The recombinant vector according to claim 7 that comprises a first vector and a second vector, wherein said first vector comprises a nucleic acid sequence encoding said antigenic HPV polypeptides from E1, said antigenic HPV polypeptides from E2, and said antigenic HPV polypeptides from E7, and wherein said second vector comprises a nucleic acid sequence encoding said antigenic HPV polypeptides from E6.

20. The recombinant vector according to claim 1 that comprises a first vector and a second vector, wherein said first vector comprises a nucleic acid sequence encoding a polypeptide of SEQ ID NO:85, SEQ ID NO:86, or SEQ ID NO:132, and wherein said second vector comprises a nucleic acid sequence encoding a polypeptide of SEQ ID NO:87, SEQ ID NO:88, or SEQ ID NO:133.

* * * * *